US010434161B2

(12) United States Patent
Ganta et al.

(10) Patent No.: US 10,434,161 B2
(45) Date of Patent: Oct. 8, 2019

(54) **ATTENUATED VACCINES TO PROTECT AGAINST TICK-BORNE *EHRLICHIA* SPECIES INFECTIONS**

(71) Applicant: Kansas State University Research Foundation, Manhattan, KS (US)

(72) Inventors: Roman R. Ganta, Manhattan, KS (US); Chuanmin Cheng, Manhattan, KS (US); Arathy D. S. Nair, Manhattan, KS (US); Deborah Jaworski, Stillwater, OK (US); Suhasini Ganta, Manhattan, KS (US)

(73) Assignee: Kansas State University Research Foundation, Manhattan, KS (US)

( * ) Notice: Subject to any disclaimer, the term of this patent is extended or adjusted under 35 U.S.C. 154(b) by 0 days.

(21) Appl. No.: 16/106,546

(22) Filed: Aug. 21, 2018

(65) Prior Publication Data

US 2018/0360942 A1 Dec. 20, 2018

Related U.S. Application Data

(62) Division of application No. 15/544,090, filed as application No. PCT/US2016/013933 on Jan. 19, 2016, now abandoned.

(60) Provisional application No. 62/104,998, filed on Jan. 19, 2015.

(51) Int. Cl.
*A61K 39/02* (2006.01)
*A61K 39/00* (2006.01)

(52) U.S. Cl.
CPC .... *A61K 39/0233* (2013.01); *A61K 2039/522* (2013.01); *A61K 2039/552* (2013.01); *A61K 2039/575* (2013.01)

(58) Field of Classification Search
CPC ........ A61K 2039/522; A61K 2039/552; A61K 2039/575; A61K 39/0233
See application file for complete search history.

(56) References Cited

U.S. PATENT DOCUMENTS

2005/0158277 A1 7/2005 Cinquegrani et al.
2013/0122041 A1 5/2013 Harrus et al.

OTHER PUBLICATIONS

McGill et al. PLoS One 11 (2), e0148229, pp. 1-15, 2016.*
The International Search Report and Written Opinion dated Jun. 10, 2016, in PCT/US2016/013933, filed Jan. 19, 2016.
Cheng, Chuanmin "Targeted and Random Mutagenesis of Ehrlichia Chaffeensis for the Identification of Genes Required for in vivo Infection," PLOS Pathogens, Feb. 14, 2013, vol. 9 (2).
UniProtKB entry Q2GGG5_EHRCR, Uncharacterozed phage protein, putative, *Ehrlichia chaffeensis* str. Sapulpa, Mar. 21, 2006.
Genbank Accession No. KJ567138, "Mutant Anaplasma marginale transposon Himar1, complete sequence," Apr. 15, 2014.
The Office Action dated May 15, 2018, in U.S. Appl. No. 15/544,090, filed Jul. 17, 2017.

* cited by examiner

*Primary Examiner* — Sarvamangala Devi
(74) *Attorney, Agent, or Firm* — Hovey Williams LLP

(57) ABSTRACT

Attenuated vaccines to protect vertebrate animals and people against tick-born rickettsial, *Ehrlichia* and *Anaplasma* species infections is disclosed. Also disclosed are methods to modify the organism to achieve the desired immunity through the modification of a novel genetic region involved in pathogenesis. These compounds represent a needed vaccine against an organism causing life-threatening febrile illness in humans and animals, and also represent the potential to develop new classes of drugs targeting the gene products of genes Ech_0660, Ech_0379, and Ech_0230, and their homologs of other related rickettsial pathogens.

14 Claims, 22 Drawing Sheets

Specification includes a Sequence Listing.

ATTENUATED VACCINES TO PROTECT AGAINST TICK-BORNE *EHRLICHIA* SPECIES INFECTIONS

CROSS-REFERENCE TO RELATED APPLICATIONS

The present application is a divisional of U.S. Ser. No. 15/544,090, now abandoned, which is the U.S. National Stage of International Patent Application No. PCT/US2016/013933, filed Jan. 19, 2016, which claims the priority benefit of U.S. Provisional Patent Application Ser. No. 62/104,998, filed Jan. 19, 2015, entitled ATTENUATED VACCINES TO PROTECT AGAINST TICK-BORNE *EHRLICHIA* SPECIES INFECTIONS, each of which is incorporated by reference in its entirety herein.

FEDERALLY SPONSORED RESEARCH OR DEVELOPMENT

This invention was made with government support under grant # AI070908 awarded by the National Institute of Health. The United States government has certain rights in the invention.

SEQUENCE LISTING

The following application contains a sequence listing in computer readable format (CRF), submitted as a text file in ASCII format entitled "47025-PCTSequenceListing," created on Jan. 19, 2016, as 1,526 KB. The content of the CRF is hereby incorporated by reference.

BACKGROUND OF THE INVENTION

Field of the Invention

The present invention relates to vaccines against *Ehrlichia* and *Anaplasma* species infections in vertebrate animals and people and the development of a new class of drugs.

Description of Related Art

*Ehrlichia chaffeensis* is an obligate intracellular gram-negative species of rickettsial bacteria. *E. chaffeensis* is an *Amblyomma americanum* tick-transmitted rickettsial pathogen causing persistent infections in people and several other vertebrate animals. The disease caused by *E. chaffeensis* in people is referred as the human monocytic ehrlichiosis (HME). People with HME may exhibit flu like symptoms. HME in people can cause a life-threatening febrile illness and is associated with significant morbidity, especially in people with compromised immunity. About 40-60% of cases of HME require hospitalization, and fatality rates are estimated to be around 3%. White-tailed deer is the reservoir host for the pathogen, while humans, dogs and other vertebrate hosts, such as coyotes and goats, are regarded as the incidental hosts, similar to humans.

*E. chaffeensis* infections are a major concern for people with compromised immunity, as they develop a more severe disease which also results in a higher case-fatality rate. Further, because *E. chaffeensis* infects monocytes and macrophages and the pathogen is viable in refrigerated blood, people undergoing blood transfusions and organ transplantations are also at high risk in acquiring the pathogen and can develop a severe life threatening HME disease. The limited therapeutic option of only a single class of antibiotics and the non-availability of vaccines to prevent the infection are the added challenges for both humans and companion animals. The vaccine development is complicated due to limited understanding of the influence of the host on the pathogen phenotype and immunogenicity, and the limited knowledge about the pathogen antigens involved in stimulating protective immunity. Deer, dog and *A. americanum* tick infection studies are ideal for mapping genes essential to *E. chaffeensis* growth and persistence in vertebrate and tick hosts as they are recognized as the reservoir, an incidental host and the tick vector, respectively. In particular, the dog is an ideal incidental host model similar to humans in acquiring infections with *E. chaffeensis* from an infected *A. americanum* tick. *E. chaffeensis* infections in deer and dog are very similar in exhibiting clinical symptoms, rickettsemia levels and in their antibody responses.

To date, there are no reports in the literature which describe the vaccine development against *E. chaffeensis* infections in humans and dogs. Currently, treatment with the only available antibiotic class and the supporting care are the only options of controlling the disease in people or dogs.

SUMMARY OF THE INVENTION

The present invention relates to the development of a new class of drugs derived from targeting gene regions in *Ehrlichia* species. The invention broadly includes the methodology for generating attenuated mutant strains of organisms. The utility of these attenuated organisms comes from their application as a new class of vaccines to protect people and other vertebrate animals against infection. Herein, we disclose the methodology involved in developing these mutant organisms, how these modifications result in attenuated strains, a description of the pathogen-specific antibody and $CD4^+$ T cell responses they elicit, and the resultant protective immunity against secondary challenges.

Described herein are immunogenic compositions useful to elicit an immune response against *Ehrlichia* infection (e.g., tick-transmitted *E. chaffeensis* infection or other rickettsial infections) in a subject. The compositions generally comprise live, attenuated *E. chaffeensis* dispersed in a pharmaceutically-acceptable carrier. The live, attenuated *E. chaffeensis* comprises a mutation in one or more target genes that results in attenuated growth of the bacterium in a vertebrate host organism.

Methods of inducing an immune response against *Ehrlichia* infection in a subject are also described herein. The methods generally comprise administering an immunogenic composition according to any one of embodiments described herein to the subject, for protection and/or treatment against tick-transmitted *E. chaffeensis* infection or other rickettsial infections.

Also described herein are kits for inducing an immune response against *Ehrlichia* infection in a subject. The kits generally comprise an immunogenic composition according to any one of embodiments described herein, instructions for administering the immunogenic composition to the subject.

Use of an immunogenic composition according to any one of embodiments described herein for inducing an immune response against *Ehrlichia* infection in a subject is also described herein.

BRIEF DESCRIPTION OF THE DRAWING FIGURES

The patent or application file contains at least one drawing executed in color. Copies of this patent or patent application publication with color drawing(s) will be provided by the Office upon request and payment of the necessary fee.

DETAILED DESCRIPTION

Figure 1:
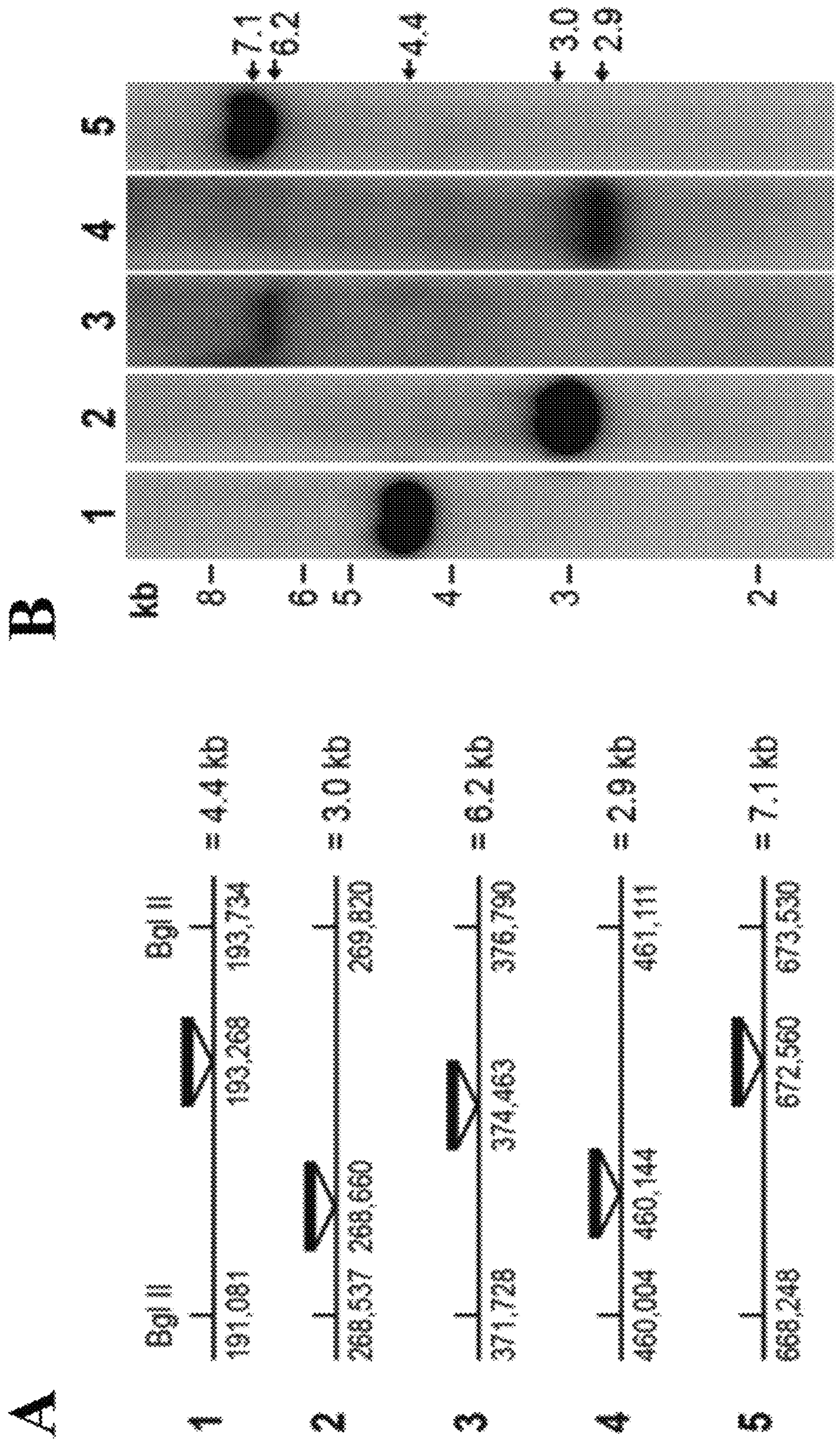
FIG. 1 is (A) an illustration of the insertions and (B) verification of clonal purity amongst five mutant strains by Southern blot.
Figure 2A:
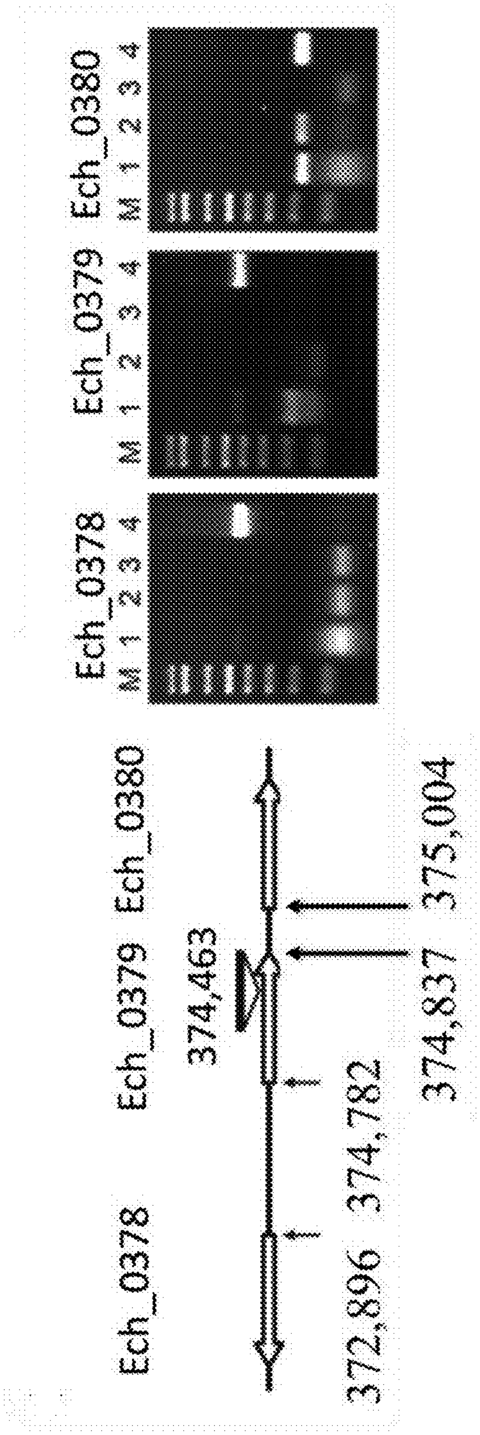
FIG. 2A is an illustration for the insertion and transcriptional analysis of genes neighboring transposon insertion sites by semi-quantitative RT-PCR.
Figure 2B:
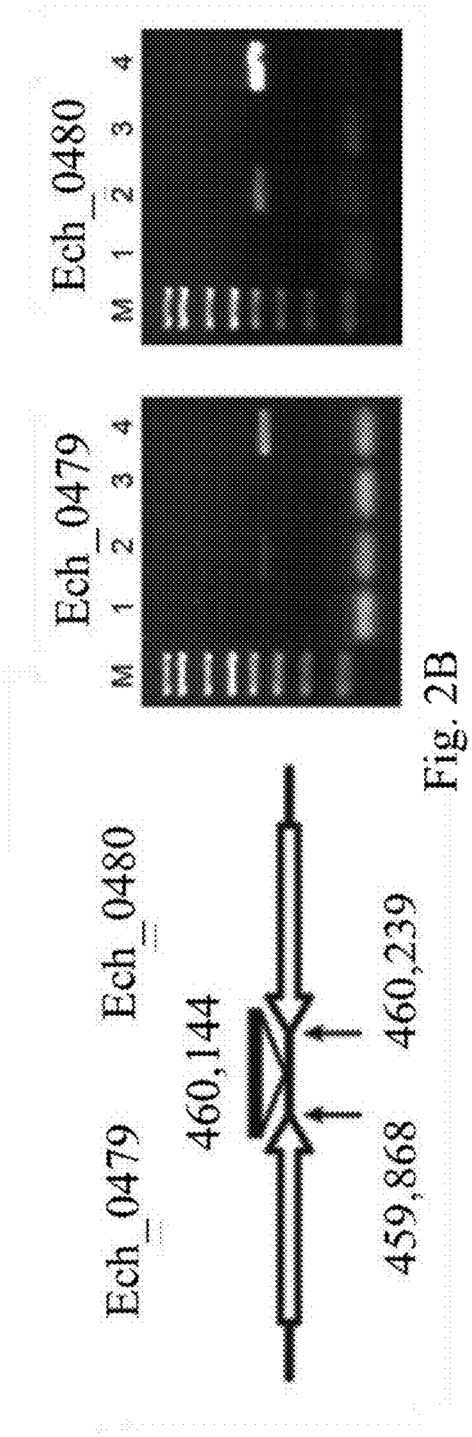
FIG. 2B is an illustration for the insertion and transcriptional analysis of genes neighboring transposon insertion sites by semi-quantitative RT-PCR.
Figure 2C:
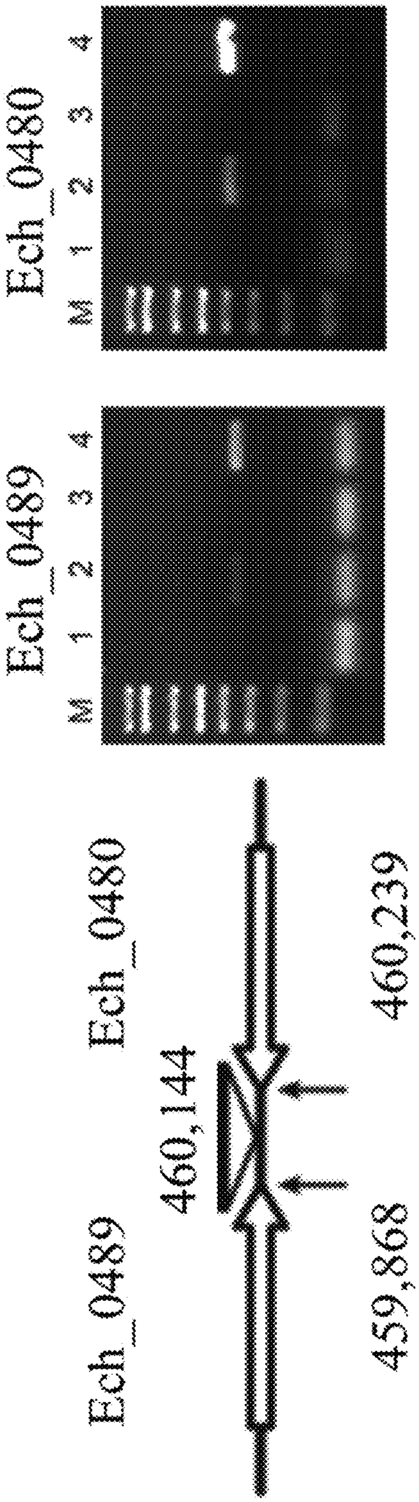
FIG. 2C is an illustration for the insertion and transcriptional analysis of genes neighboring transposon insertion sites by semi-quantitative RT-PCR.
Figure 2D:
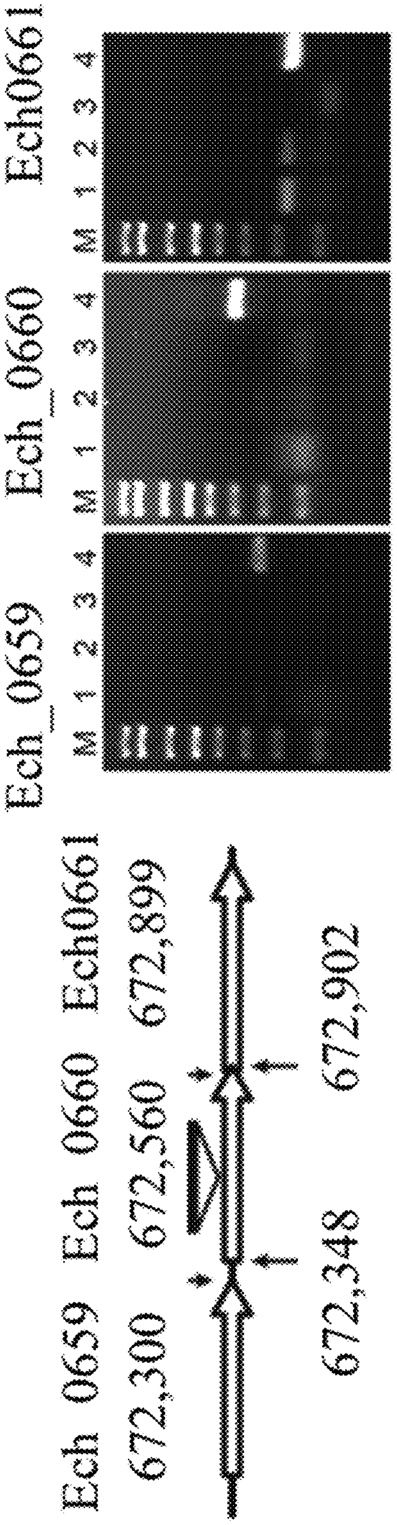
FIG. 2D is an illustration for the insertion and transcriptional analysis of genes neighboring transposon insertion sites by semi-quantitative RT-PCR.
Figure 2E:
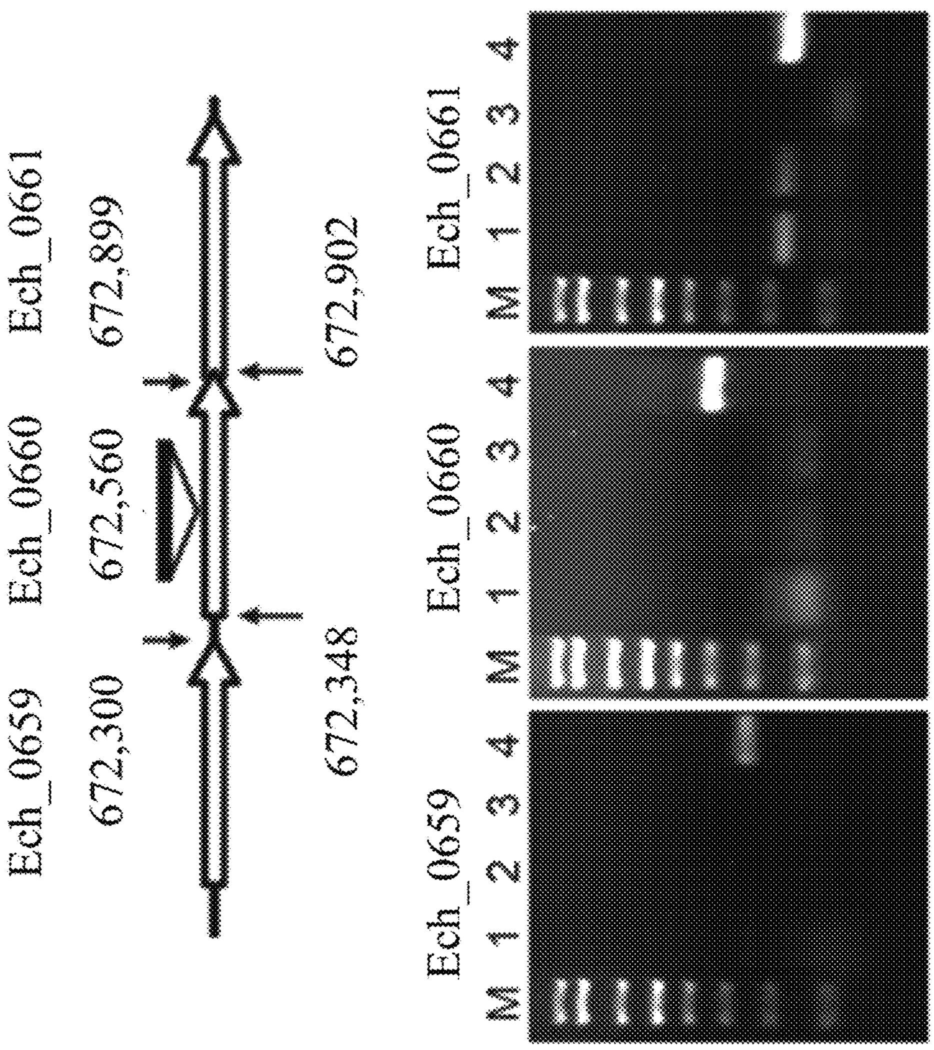
FIG. 2E is an illustration for the insertion and transcriptional analysis of genes neighboring transposon insertion sites by semi-quantitative RT-PCR.

In more detail, the invention is concerned with attenuated *Ehrlichia* strains. In one or more embodiments, the invention is concerned with attenuated *E. chaffeensis*. In particular, the invention is concerned with live attenuated mutant *E. chaffeensis* strains, and corresponding immunogenic compositions for eliciting immune responses against *Ehrlichia* infection, and particularly tick-transmitted *E. chaffeensis* infection. In one or more embodiments, the live attenuated mutants are *E. chaffeensis* str. Arkansas (Genbank CP000236.1, incorporated by reference herein, SEQ ID NO:1). In one or more embodiments, the attenuated mutant strain of *E. chaffeensis* comprises a mutation in one or more genes that results in attenuated growth of the bacterium in a vertebrate host organism. In one or more embodiments, the mutation is an insertion in gene protein coding region of a target gene itself or in sequences responsible for, or involved in, controlling gene expression. In another aspect, the mutation results in an insertion in the gene, wherein the insertion causes altered expression of a gene product encoded by the genes near the insertion causing an inactive gene product encoded by the mutated gene. In one or more embodiments, the attenuated mutant strain of *E. chaffeensis* comprises an insertion mutation in one or more genes that results in attenuated growth of the bacterium in the host organism. In one or more embodiments, the mutation is stably incorporated into the mutant strain's genome. In one or more embodiments, the insertion mutation is transposon-based, random mutagenesis generating a stable insertion mutation in one or more *E. chaffeensis* genes. In one or more embodiments, the mutation causes transcriptional inactivation of a bacterial membrane protein gene in the mutated strain.

In one or more embodiments, the gene is selected from the group consisting of Ech_0660 (SEQ ID NO:2), Ech_0379 (SEQ ID NO:4), and Ech_0230 (SEQ ID NO:6). In one or more embodiments, the attenuated mutant strain of *E. chaffeensis* comprises a mutation in the phage-like structure connector protein encoding gene, Ech_0660 (SEQ ID NO:2). In one or more embodiments, the attenuated mutant strain of *E. chaffeensis* comprises an insertion mutation in the phage-like protein encoding gene, Ech_0660 (SEQ ID NO:2), and more preferably a transposon (random) insertion mutation in Ech_0660 (SEQ ID NO:2). In one or more embodiments, the attenuated mutant strain of *E. chaffeensis* comprises an insertion mutation in the putative Na+/H+ antiporter protein encoding gene, Ech_379 (SEQ ID NO:4), and more preferably a transposon (random) insertion mutation in Ech_0379 (SEQ ID NO:4). In one or more embodiments, the attenuated mutant strain of *E. chaffeensis* comprises an insertion mutation in the putative membrane protein encoding gene, Ech_0230 (SEQ ID NO:6), and more preferably a transposon (random) insertion mutation in Ech_0230 (SEQ ID NO:6). In one or more embodiments, the mutation results in inhibition and/or inactivation of transcription and/or translation of a gene product (protein) selected from the group consisting of SEQ ID NO:3 (Genbank ABD45123.1), SEQ ID NO:5 (Genbank ABD44646), and SEQ ID NO:7 (Genbank ABD45256.1).

In one or more embodiments, the insertion sequence comprises at least one heterologous sequence, and preferably at least one reporter stably incorporated therein. In one or more embodiments, the heterologous sequence comprises an in vivo inducible promoter, and preferably a promoter related to a heterologous transcription regulator gene, such as from a different *Ehrlichia* strain or species or *Anaplasma* species. In one or more embodiments, the heterologous sequence is a promoter from *Anaplasma marginale* transcription regulator gene. In one or more embodiments, the heterologous sequence is fused to at least one reporter gene, such as a fluorescence gene, antibiotics resistance gene, and the like. Reporter genes assist in identification of successfully generated mutant strains from the wild type (wt) by making the mutant bacteria resistant to an antibiotic (e.g., Streptomycin/Spectinomycin resistance gene) or give off a fluorescence signal (e.g., mCherry fluorescence gene, GFUuv fluorescence gene). In one or more embodiments, the insertion sequence is engineered by molecular cloning of these fragments into a plasmid vector, followed by replication to obtain a large quantity of the engineered plasmid. This plasmid can then be used to generate the mutant strain. In one or more embodiments, the mutation comprises insertion of SEQ ID NO:8 into the target gene. In one or more embodiments, the mutation comprises insertion of SEQ ID NO:9 into the target gene.

In one or more embodiments, the attenuated mutant strain of *E. chaffeensis* is generated by transpositional insertion causing altered expression of several genes positioned upstream and downstream to the insertion sites. In one or more embodiments, the attenuated mutant strain of *E. chaffeensis* comprises one or more mutated genes selected from the group consisting of SEQ ID NO:10 (mutated sequence for Ech_0660), SEQ ID NO:11 (mutated sequence for Ech_0379), and SEQ ID NO:12 (mutated sequence for Ech_0230; note that the insertion mutant in Ech_0230 is inserted 17 nt downstream from the wild type stop codon). The effect of the inactivation of these genes causes attenuation of the organism's growth in vertebrate hosts, but does not impact its acquisition and persistence in ticks. In one or more embodiments, the invention is concerned with other live attenuated mutant strains of *Ehrlichia canis, Ehrlichia ewingii, Ehrlichia muris, Ehrlichia muris*-like agent infectious to humans, *Anaplasma phagocytophilum, Anaplasma marginale*, and/or *Anaplasma platys*. The mutants comprise a mutation in a gene homologous to *E. chaffeensis* gene Ech_0660, Ech_0379, or Ech_230, which results in attenuated growth of the bacterium in a vertebrate host organism.

Regardless, the resulting mutant *E. chaffeensis* can be used in immunogenic compositions to elicit an immune response against *Ehrlichia* infection in a subject. In some embodiments, the mutant *E. chaffeensis* can be used as a vaccine for immunizing a subject against *Ehrlichia* infection. The term "vaccine" is used interchangeably herein with "immunogenic composition" and refers to compositions capable of eliciting partial or complete immunogenic protection against a disease or condition in the subject to which it has been administered. Although vaccines are generally considered prophylactic, the vaccines may be used for therapeutic treatment of a disease or a condition. The terms "prophylactic" or "prevent," as used herein, refer to vaccines that are intended to inhibit or ameliorate the effects of a future infection or disease to which a subject may be exposed (but is not currently identified as having been infected with). In other words, for prophylactic use, the subject generally does not (yet) show observable signs/symptoms of infection prior to administration of the immunogenic composition. In some cases the vaccine may prevent the development of observable morbidity from infection (i.e., near 100% prevention). In other cases, the vaccine may only partially prevent and/or lessen the extent of morbidity due to the infection (i.e., reduce or mitigate the severity of the symptoms and/or effects of the infection, and/or reduce or mitigate the duration of the infection/symptoms/effects). In either case, the vaccine is still considered to "prevent" the target infection or disease in the context of this disclosure. Conversely, the terms "therapeutic" or "treat," as used herein, refer to vaccines that are intended to produce a beneficial change in an existing condition (e.g., infection, disease) of a subject, such as by reducing the severity of the clinical symptoms and/or effects of the infection, and/or reducing the duration of the infection/symptoms/effects.

The vaccines comprise the mutant *E. chaffeensis* strain(s) described herein dispersed in a pharmaceutically-acceptable carrier. The term carrier is used herein to refer to diluents, excipients, vehicles, and the like, in which the mutant *E. chaffeensis* strain(s) may be dispersed for administration. Suitable carriers will be pharmaceutically acceptable. As used herein, the term "pharmaceutically acceptable" means not biologically or otherwise undesirable, in that it can be administered to a subject without excessive toxicity, irritation, or allergic response, and does not cause unacceptable biological effects or interact in a deleterious manner with any of the other components of the composition in which it is contained. A pharmaceutically-acceptable carrier would naturally be selected to minimize any degradation of the mutant *E. chaffeensis* strain(s) or other agents and to minimize any adverse side effects in the subject, as would be well known to one of skill in the art. Pharmaceutically-acceptable ingredients include those acceptable for veterinary use as well as human pharmaceutical use, and will depend on the route of administration. For example, compositions suitable for administration via injection are typically solutions in sterile isotonic aqueous buffer. Exemplary carriers include aqueous solutions such as normal (n.) saline (~0.9% NaCl), phosphate buffered saline (PBS), sterile water/distilled autoclaved water (DAW), aqueous dextrose solutions, aqueous glycerol solutions, ethanol, normal allantoic fluid, various oil-in-water or water-in-oil emulsions, as well as dimethyl sulfoxide (DMSO) or other acceptable vehicles, and the like.

The vaccine can comprise a therapeutically effective amount of live attenuated mutant *E. chaffeensis* dispersed in the carrier. As used herein, a "therapeutically effective" amount refers to the amount that will elicit the biological or medical response of a tissue, system, or subject that is being sought by a researcher or clinician, and in particular elicit some desired protective effect as against the infection by priming or stimulating an immune response specific for one or more strains of *E. chaffeensis*. One of skill in the art recognizes that an amount may be considered therapeutically "effective" even if the condition is not totally eradicated or prevented, but it or its symptoms and/or effects are improved or alleviated partially in the subject. In some embodiments, the composition will comprise from about 5% to about 95% by weight of a mutant *E. chaffeensis* described herein, and preferably from about 30% to about 90% by weight of the mutant *E. chaffeensis*, based upon the total weight of the composition taken as 100% by weight. In some embodiments, combinations of more than one type of the described *E. chaffeensis* mutants can be included in the composition, in which case the total levels of all such mutant *E. chaffeensis* strains will preferably fall within the ranges described above. Such multi-valent vaccines are preferred for use in vaccination in some embodiments. In some embodiments, modifications may be made to the insertions, such as deletions of the antibiotic cassette or creation of new targeted insertions within the genes Ech_0660, Ech_0379, or Ech_0230 to improve the vaccine effectiveness. In some embodiments, similar mutations may be made in other *Ehrlichia* and *Anaplasma* species pathogens impacting the health of people and dogs upon their infections and they will be used similarly as vaccines.

Other ingredients may be included in the composition, such as adjuvants, other active agents, preservatives, buffering agents, salts, other pharmaceutically-acceptable ingredients, including residual amounts of ingredients used in vaccine manufacturing. The term "adjuvant" is used herein to refer to substances that have immunopotentiating effects and are added to or co-formulated in the vaccine composition in order to enhance, elicit, and/or modulate the innate, humoral, and/or cell-mediated immune response against the vaccine components. Suitable adjuvants include: aluminum salts, such as aluminum hydroxide, aluminum phosphate, alum (potassium aluminum sulfate), or mixed aluminum salts, peptides, oil or hydrocarbon emulsions, or any other adjuvant deemed suitable for human or animal use. In some embodiments, the vaccine is substantially free of any adjuvants, where the term "substantially free" means that the ingredient is not intentionally added or part of the composition, although it is recognized that residual or incidental amounts or impurities may be present in low amounts (e.g., less than about 0.1% by weight and preferably less than about 0.01% by weight, based upon the total weight of the composite taken as 100% by weight). Other active agents that could be included in the composition include antiviral compounds or any immunogenic active components (e.g., antigens) such as those that resemble a disease-causing microorganism or infectious agent, and/or are made from weakened or killed forms of the same, its toxins, subunits, particles, and/or one of its surface proteins, such that it provokes an immune response to that microorganism or infectious agent. In addition to live, modified, or attenuated vaccine components, active agents using recombinant or synthetic peptides/proteins, carbohydrates, or antigens can also be used, including those targeted to the gene products of Ech_0660, Ech_0379, and/or Ech_0230. Antibiotics can also be used as part of vaccine production and may be present in small amounts in the vaccine, such as neomycin, polymyxin B, streptomycin and gentamicin. In some embodiments, the vaccine composition is substantially free of any other active (immunogenic) agents, other than the mutant *E. chaffeensis* and optional adjuvant, dispersed in the carrier.

In use, the vaccine composition is administered to a subject. Various routes of administration can be used depending upon the particular carrier and other ingredients used. For example, the vaccine can be injected intramuscularly, subcutaneously, intradermally, or intravenously using a needle and syringe, or a needleless injection device. The vaccine can also be administered mucosally, such as intranasal administration. For intranasal administration, the vaccine composition is usually administered through the nasal passage as drops, large particle aerosol (greater than about 10 microns), or spray into the upper respiratory tract. While stimulation of a protective immune response with a single dose is preferred, additional dosages can be administered, by the same or different route, to achieve the desired prophylactic or therapeutic effect. The vaccine can also be administered using a prime and boost regime if deemed necessary. In some embodiments, the methods described herein are useful for preventing the occurrence or incidence of *Ehrlichia* infection and/or preventing the effects of *Anaplasma* infection, as described above.

In some embodiments, the vaccine can be provided in unit dosage form in a suitable container. The term "unit dosage form" refers to a physically discrete unit suitable as a unitary dosage for human or animal use. Each unit dosage form may contain a predetermined amount of the vaccine (and/or other active agents) in the carrier calculated to produce the desired effect. In other embodiments, the vaccine can be provided separate from the carrier (e.g., in its own vial, ampule, sachet, or other suitable container) for on-site mixing before administration to a subject. A kit comprising the vaccine is also disclosed herein. The kit further comprises instructions for administering the vaccine to a subject. The virus can be provided as part of a dosage unit, already dispersed in a pharmaceutically-acceptable carrier, or it can be provided separately from the carrier. The kit can further comprise instructions for preparing the virus for administration to a subject, including for example, instructions for dispersing the virus in a suitable carrier.

Advantageously, vaccination with live, attenuated mutant *E. chaffeensis* induces pathogen-specific humoral and cellular immunity, and protection from tick-transmitted *E. chaffeensis* infection in a physiologic host. In one or more embodiments, vaccination with live, attenuated mutant *E. chaffeensis* generates a host response that is protective against infection in both the reservoir host (deer) and in an incidental host (dogs). In one or more embodiments, vaccination is completely protective against infection (Ech_0660 mutation). In one or more embodiments, vaccination is at least partially protective against infection (Ech_0379 mutation). In some embodiments, the immunogenic composition comprises a mixture of mutated *E. chaffeensis* strains comprising at least a mutation in Ech_0660 in one strain and a mutation in Ech_0379 in a second strain.

In one or more embodiments, administering the immunogenic composition to a subject will result in reducing rickettsemia when the subject is exposed to *Ehrlichia*, and/or artificially challenged with a wild type infection. In one or more embodiments, administering the immunogenic composition to a subject will result in complete clearance of the pathogen from both reservoir and incidental hosts. In one or more embodiments, administering the immunogenic composition to a subject will result in a rise in *E. chaffeensis*-specific antibody titers in the subject. In one or more embodiments, administering the immunogenic composition to a subject will result in a significant Th1 response in peripheral blood of the subject as measured by *E. chaffeensis* antigen-dependent CD4+ T cell proliferation and IFNγ production. In one or more embodiments, administering the immunogenic composition to a subject will result in a significant IL-17 production by peripheral blood leukocytes in the subject. In one or more embodiments, administering the immunogenic composition to a subject will does not result a significant antigen-dependent CD8+ T cell response in the subject.

Using the methodology and technology described herein, different attenuated *Ehrlichia* and/or *Anaplasma* vaccines can be developed and used for canines, and other species including, but not limited to human, equine, *cervus* (deer), feline, goats, non-human primate, and the like.

The methods can be also applied for clinical research and/or study. Thus, kits for study and/or generation of additional mutant *Ehrlichia* strains are also described herein. The kits comprise vectors (plasmids) as described herein encoding for the insertional mutations. The kit can also include vectors encoding for the target genes. Alternatively, such sequences can be determined by the end-user. The kit may include plasmids for subsequently inserting the insertional mutation sequences for generation of the mutant *Ehrlichia* strains. The kit may further include additional components, including cells, culture medium, buffers, along with instructions for their use to generate the mutant *Ehrlichia* strains.

The methods can also be applied towards developing drugs targeting the gene products of genes Ech_0660, Ech_0379, and Ech_0230, and their homologs of other related rickettsial pathogens to inhibit or reduce the effects, severity, or symptoms of *Ehrlichia* or *Anaplasma* infections.

Additional advantages of the various embodiments of the invention will be apparent to those skilled in the art upon review of the disclosure herein and the working examples below. It will be appreciated that the various embodiments described herein are not necessarily mutually exclusive unless otherwise indicated herein. For example, a feature described or depicted in one embodiment may also be included in other embodiments, but is not necessarily included. Thus, the present invention encompasses a variety of combinations and/or integrations of the specific embodiments described herein.

As used herein, the phrase "and/or," when used in a list of two or more items, means that any one of the listed items can be employed by itself or any combination of two or more of the listed items can be employed. For example, if a composition is described as containing or excluding components A, B, and/or C, the composition can contain or exclude A alone; B alone; C alone; A and B in combination; A and C in combination; B and C in combination; or A, B, and C in combination.

The present description also uses numerical ranges to quantify certain parameters relating to various embodiments of the invention. It should be understood that when numerical ranges are provided, such ranges are to be construed as providing literal support for claim limitations that only recite the lower value of the range as well as claim limitations that only recite the upper value of the range. For example, a disclosed numerical range of about 10 to about 100 provides literal support for a claim reciting "greater than about 10" (with no upper bounds) and a claim reciting "less than about 100" (with no lower bounds).

EXAMPLES

The following examples set forth methods in accordance with the invention. It is to be understood, however, that these examples are provided by way of illustration and nothing therein should be taken as a limitation upon the overall scope of the invention.

Introduction

Figure 11A:
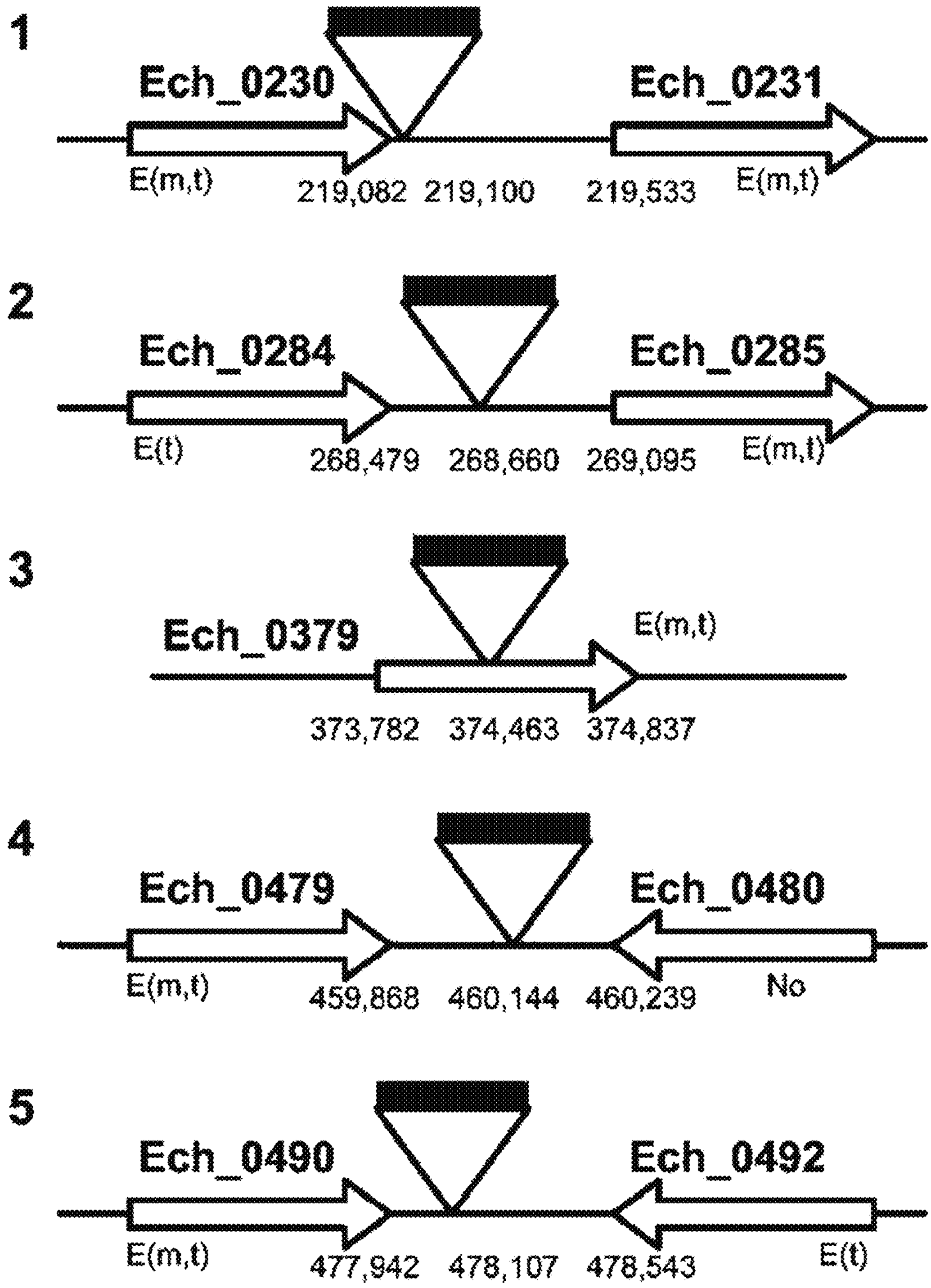
FIG. 11A is an illustration of genomic locations for transposon mutation in *E. chaffeensis*.
Figure 11B:
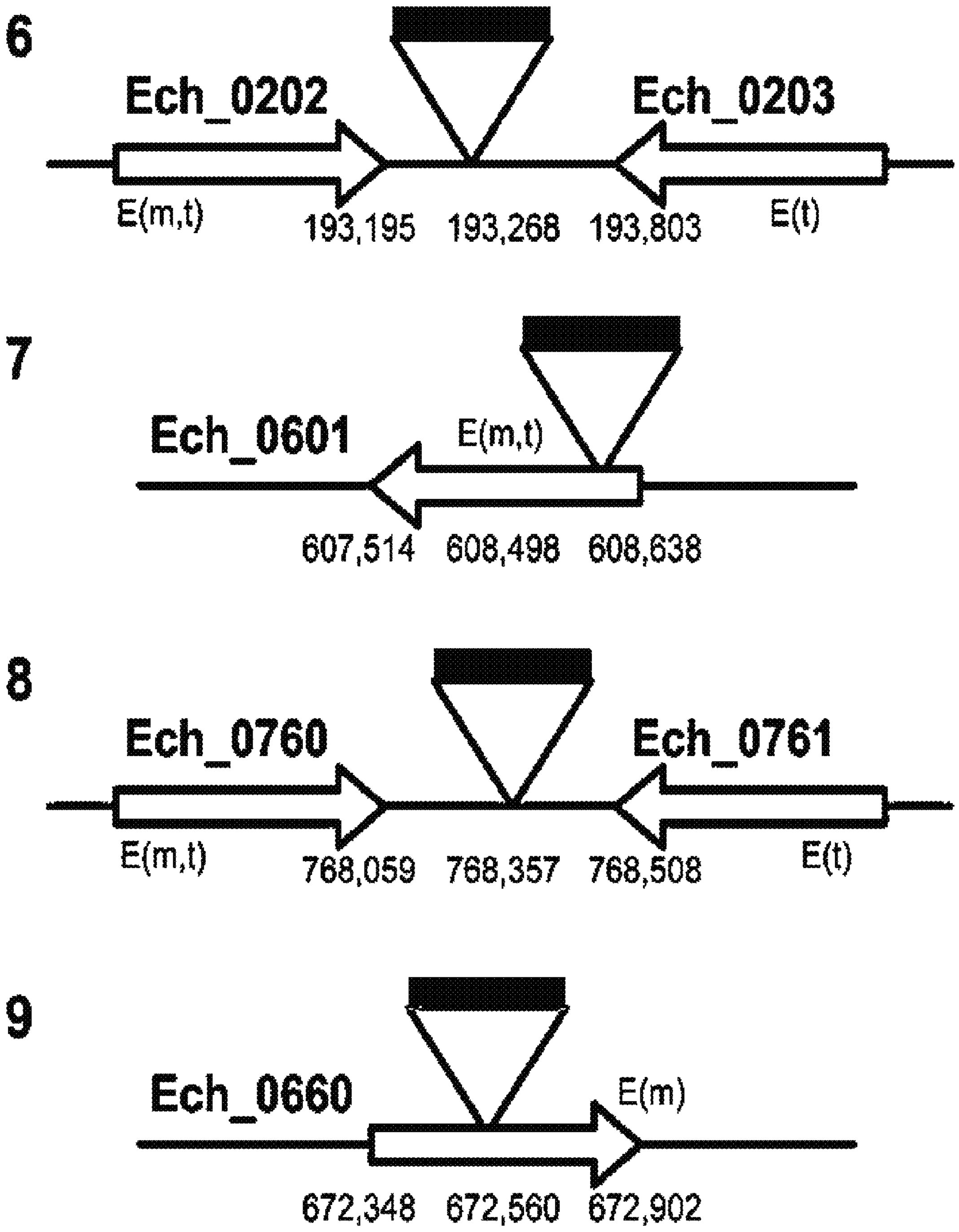
FIG. 11B is an illustration of genomic locations for transposon mutation in *E. chaffeensis.*

In a recent study, we described nine transposon insertion mutations in *E. chaffeensis* (Cheng et al., Targeted and Random Mutagenesis of *Ehrlichia chaffeensis* for the Identification of Genes Required for In vivo Infection PLOS Pathogens, Vol. 9, Iss. 2 (2013), incorporated by reference herein) (see FIG. 11). Genomic locations of the insertion sites and the genes at or near the insertions, as per the whole genome data (GenBank # CP000236.1) are shown in FIG. 11. *E. chaffeensis* genomic DNAs from three independent transformations with mCherry (one transformation) and GFPuv (two transformations) Himar1 transposon plasmids were used to determine the integration locations by inverse PCRs and ST-PCRs followed by DNA sequence analysis. Genomic locations of the insertion sites and the genes at or near the insertions were presented. The gene expression data assessed by RT-PCR are also included in the figure (E, expressed gene; m, in macrophage culture; t, in tick cell culture; No, gene not expressed). The insertions in mCherry transformants are shown on the left, and insertions in GFPuv transformants are depicted on the right. Numbers 6-8 are the first GFPuv transformants, and number 10 is the second GFPuv transformant).

In the current study, we investigated the impact of the insertion mutations in the pathogen's growth in an incidental host, tick and in altering transcriptional activities of genes near to the insertion sites. The potential of attenuated mutants to confer protection against infection challenge was also investigated. We present the first evidence that transposon mutations in *E. chaffeensis* cause polar effects in impacting gene expression from the nearby genes, in addition to disrupting gene functions for mutations existing within a gene. Further, we report that the transposon insertion mutation within the Ech_0660 gene causes attenuation and offers protection against infection challenges in both deer and dogs.

The *E. chaffeensis* Arkansas isolate (wild type and the mutants) and *E. canis* Oklahoma strain were continuously cultivated in the macrophage like cell line (DH82) for use in examples described below. Animal experiments with deer and dogs were performed by complying with the Public Health Service (PHS) Policy on the Humane Care and Use of Laboratory Animals, the US Department of Agriculture's (USDA) Animal Welfare Act & Regulations (9CFR Chapter 1, 2.31), and with approvals of the Oklahoma State University (OSU) and Kansas State University (KSU) Institutional Animal Care and Use Committees (IACUC), and as per the guidelines of the protocols. Laboratory-reared deer and pure-bred laboratory-reared dogs were used for conducting infection experiments. Purebred beagle dogs of 5-6 months of age of either sex were obtained from Covance Research Products (Denver, Pa.). Infection experiments were done according to established protocols.

The quantitative IgG ELISA data were analyzed using the 2-tailed unpaired Student t test (GraphPad software, graphpad.com, La Jolla, Calif.). Statistical significance was set for differences between the experimental groups at $P \leq 0.05$. To maximize power to detect differences, T cell and antibody responses were compared using an analysis of variance accounting for the repeated measures on animals over time and the nesting of animals within each infection group was performed as previously described. For cytokine assays, ELISA results on cell culture supernatants from day 7-post infection were analyzed using a 1-way ANOVA with Bonferri post-test analysis.

Example 1 illustrates the clonal purification and verification of *E. chaffeensis* mutants. Example 2 illustrates the impact of mutations on the transcriptional activities of genes near the insertion sites by RT-PCR analysis. Example 3 illustrates the infection of animals with strains of mutant or wild type *E. chaffeensis* and the impact of these mutations on *E. chaffeensis* growth in an incidental host. Example 4 illustrates the needle infection of *A. americanum* ticks with mutants or wild type *E. chaffeensis* cultures. Example 5 illustrates the antibody, CD8+, and CD4+ T Cell responses to vaccination and challenge. Example 6 illustrates that attenuated mutants confer protection against wild type infection challenge in deer and dogs

Example 1

Clonal Purification and Verification of *E. chaffeensis* Mutants

Transposon mutants of *E. chaffeensis* were clonally purified by limiting dilution Briefly, host cell-free *E. chaffeensis* mutant pools were prepared, the numbers of organisms were estimated using a hemocytometer, and diluted to generate about one infected cell to be transferred per chamber in a 48-well plate containing confluent DH82 cells and incubated at 37° C. When the infectivity reached to ~80%, 0.7 ml culture from each well was harvested for genomic DNA isolation. The remaining culture was transferred to a T25 flask containing confluent DH82 cells for expanding the culture growth. Clonal purity of mutants was assessed by PCR targeting to each insertion region and by performing Southern blot analysis with genomic DNA digested with Bgl II and hybridized with insertion-specific spectinomycin (aad) probe. Blots were assessed for the presence of single predicted DNA fragments for each clonal mutant.

To characterize the mutant organisms, we clonally purified five mutants by limiting dilution technique; Ech_0202, Ech_0284, Ech_0379, Ech_0480, and Ech_0660; clonal purity of mutants was verified by Southern blot analysis (FIG. 1). Expected genomic DNA fragments for the Bgl II restriction endonuclease digestion, estimated from the position of transposon insertions, were calculated (FIG. 1A) and observed in DNA of each purified mutant as illustrated by agarose gel electrophoresis (FIG. 1B). Lanes 1-5 represent the mutants Ech_0202, Ech_0284, Ech_0379, Ech_0480 and Ech_0660, respectively.

Example 2

Impact of Mutations on the Transcriptional Activities of Genes Near the Insertion Sites by RT-PCR Analysis Total RNA, free of contaminated genomic DNA, was isolated as according to standard protocols. RNA concentrations from wild type and clonal mutants were equalized and semi-quantitative RT-PCR targeting *E. chaffeensis* genes surrounding the transposon insertion sites was performed by 35 cycles of amplification using the gene specific primer sets described in Table 1.

TABLE 1

Primers used for RT-PCR of genes surrounding the insertion sites

| Primer name | Gene target | Amplicon size (bp) | Primer sequence |
|---|---|---|---|
| RRG1382 | Ech_0202 | 314 | 5'-ttg ctg ata gtg tgg cag ctg aag (SEQ ID NO: 13) |
| RRG1383 | | | 5'-tct cca tct tgg ata aca gca gg (SEQ ID NO: 14) |
| RRG1384 | Ech_0203 | 175 | 5'-tgt gtc ctg ttg tta tgg gtt ctc (SEQ ID NO: 15) |
| RRG1385 | | | 5'-tcc cta agt aat atg gaa cca tct gca c (SEQ ID NO: 16) |
| RRG1370 | Ech_0284 | 380 | 5'-tct gct aga agt gct act cta gg (SEQ ID NO: 17) |
| RRG1371 | | | 5'-tcc cac agt gta gct ctc tgc (SEQ ID NO: 18) |
| RRG1372 | Ech_0285 | 417 | 5'-atg act gct gcc att aca gtt ggg (SEQ ID NO: 19) |
| RRG1373 | | | 5'-cct cat cac ttg ttc ctc ctt c (SEQ ID NO: 20) |
| RRG1632 | Ech_0378 | 446 | 5'-tgc tat agg gat acc tgt agc ttt tgc (SEQ ID NO: 21) |
| RRG1633 | | | 5'-gca aga cca tcg tac gta cta ggt g (SEQ ID NO: 22) |
| RRG1276 | Ech_0379 | 373 | 5'-cta agg ttg tag gga atg caa cc (SEQ ID NO: 23) |
| RRG1277 | | | 5'-aca agg taa gta cct tgc ttg ctc (SEQ ID NO: 24) |
| RRG1634 | Ech_0380 | 161 | 5'-atg tgc tct gta tca att gct tg (SEQ ID NO: 25) |
| RRG1635 | | | 5'-aac aaa gaa gta aaa aga cat aca tg (SEQ ID NO: 26) |
| RRG1374 | Ech_0479 | 357 | 5'-act cct tgg caa tgg tgt gta g (SEQ ID NO: 27) |
| RRG1375 | | | 5'-aat cgc tct aga caa cac tga agg (SEQ ID NO: 28) |
| RRG1376 | Ech_0480 | 368 | 5'-tat gta act tct ttg cct ctt atg (SEQ ID NO: 29) |
| RRG1377 | | | 5'-atg aaa tct tta gtg act cga cc (SEQ ID NO: 30) |
| RRG1636 | Ech_0659 | 224 | 5'-act aga tga att tga cta tac aat tga tg (SEQ ID NO: 31) |
| RRG1637 | | | 5'-ttt aag ctt tgt aag ctg tta gaa t (SEQ ID NO: 32) |
| RRG1344 | Ech_0660 | 265 | 5'-tgt acc tgt atc ctc acc tat cac c (SEQ ID NO: 33) |
| RRG1345 | | | 5'-cta tca att ctt cac ttc cat ttg tgt g (SEQ ID NO: 34) |
| RRG1638 | Ech_0661 | 155 | 5'-atc tac tgc tac caa ccc aat ac (SEQ ID NO: 35) |
| RRG1639 | | | 5'-tag tgc ata tgc aat ttc att gtg c (SEQ ID NO: 36) |

Insertional mutations within Ech_0230, Ech_0379 and Ech_0660 caused transcriptional inactivation from these genes. To assess the polar effects in altering transcriptional activities of genes surrounding the insertions, we evaluated transcription from genes located immediately upstream and downstream to insertion sites for the five clonally purified mutants (FIG. 2). Total RNA isolated from wild-type *E. chaffeensis* (lane 1) and clonal mutants (lane 2) was assessed for the genes 5' and 3' to insertion sites by semi quantitative RT-PCR. FIGS. 2A-2D have the cartoons depicting the insertions within the genome and the genes near the insertions 111, along with corresponding RT-PCR products resolved on agarose gels for each of the respective genes. No template controls (lane 3) and wild type genomic DNA template reactions (lane 4) were included to serve as negative and positive controls, respectively for each reaction. M represents 1 kb plus DNA ladder (Life Technologies Inc. Carlsbad, Calif.). With exception of the intergenic mutation downstream to Ech_0202, all other mutations influenced the transcript levels from the genes immediately upstream and/or downstream to the insertion sites. The insertion 3' to Ech_0284 caused an enhancement of gene expression from the Ech_0285 gene. Similarly, mutation within Ech_0379 caused decline of the transcription to undetectable levels from the upstream gene, Ech_0378, similar to the loss of transcription from Ech_0379 gene previously published, while not impacting the transcript level for the downstream gene, Ech_0380. The mutation 3' to Ech_0479 enhanced transcription from this gene and also activated the transcriptionally silent gene, Ech_0480. Mutation within Ech_0660 resulted in the decline in transcription to undetectable level from Ech_0659, similar to transcript knockdown from Ech_0660 gene. This mutation had no impact on the transcript level of Ech_0661.

Example 3

Infection of Animals with Strains of Mutant or Wild Type *E. chaffeensis* and the Impact of these Mutations on *E. chaffeensis* Growth in an Incidental Host Animals were injected with transposon mutants as a pool, clonally purified organisms, or with wild type *E. chaffeensis*. Inocula were prepared and inoculated with an estimated concentration of ~$2\times10^8$ *Ehrlichia* organisms in 1 ml. The presence of mutants and wild type organisms in an animal was assessed in blood drawn several days post infection by performing culture recovery or by nested PCR analysis.

*E. chaffeensis* transposon mutants grew well under in vitro culture conditions, while their growth and persistence in the reservoir host, white-tailed deer, was variable; insertions causing transcriptional inactivation from three putative membrane protein encoding genes Ech_0230, Ech_0379 and Ech_0660 resulted in the attenuated growth in deer. To examine if the mutations similarly impacted the pathogen's growth in an incidental host, we conducted experimental infection studies in three dogs. Infection progression in the dogs was followed for 44 days by sampling blood once every 2-7 day intervals. The dogs tested positive for the mutants similar to our prior observations in deer when assessed by culture recovery and/or insertion-specific PCRs at various time points post infections (Table 2). As in deer, dogs tested negative for the same three insertion mutations at Ech_0230, Ech_0379 and Ech_0660 genes. In addition, the mutant near Ech_0202 gene was undetectable. Evaluation Ech_0202, Ech_0601 and Ech_0760 mutants in vivo was assessed for the first time. Ech_0601 is an intragenic mutation, while Ech_0202 and Ech_0760 mutations are intergenic mutations downstream from the coding sequences of Ech_0202 and Ech_0760 genes, respectively. As the mutants' progression in dogs is similar to deer for the previously assessed six mutants, we reasoned that the infection progression with Ech_0202, Ech_0601 and Ech_0760 mutants in deer will also be similar to dogs. We followed infection for two months in a deer with a pool of these three mutants (Table 3). As in dogs, Ech_0202 mutant was undetectable in deer, while Ech_0601 and Ech_0760 mutants persisted.

Mutants with attenuated growth in vertebrate host species were considered vaccine candidates.

TABLE 2

Verification of the *E. chaffeensis* infection status by nested PCR targeting to the transposon insertion sites in mutant pool infected dog blood [#]

| | | Days post infection | | | | | | | | | | | | |
|---|---|---|---|---|---|---|---|---|---|---|---|---|---|---|
| | Insertion site | 0 | 2 | 5 | 7 | 9 | 12 | 14 | 16 | 19 | 21 | 29 | 35 | 44 |
| Dog 1 | Ech_0202 | − | − | − | − | − | − | − | − | − | − | − | − | − |
| | Ech_0230 | − | − | − | − | − | − | − | − | − | − | − | − | − |
| | Ech_0379 | − | − | − | − | − | − | − | − | − | − | − | − | − |
| | Ech_0480 | − | + | + | + | + | + | − | + | − | − | + | + | + |
| | Ech_0490 | − | − | − | − | − | − | + | + | + | − | + | − | − |
| | Ech_0601 | − | − | − | − | − | − | − | − | − | − | − | − | + |
| | Ech_0660 | − | − | − | − | − | − | − | − | − | − | − | − | − |
| | Ech_0760 | − | − | − | − | − | − | + | − | − | − | + | − | − |
| Dog 2 | Ech_0202 | − | − | − | − | − | − | − | − | − | − | − | − | − |
| | Ech_0230 | − | − | − | − | − | − | − | − | − | − | − | − | − |
| | Ech_0379 | − | − | − | − | − | − | − | − | − | − | − | − | − |
| | Ech_0480 | − | + | + | + | − | − | + | − | − | − | + | + | + |
| | Ech_0490 | − | + | − | − | − | − | − | − | − | − | − | − | − |
| | Ech_0601 | − | − | − | − | + | − | − | − | − | − | − | − | − |
| | Ech_0660 | − | − | − | − | − | − | − | − | − | − | − | − | − |
| | Ech_0760 | − | − | − | − | − | − | − | − | − | − | − | + | + |
| Dog 3 | Ech_0284 | − | − | − | − | − | − | + | + | + | + | + | − | + |

[#] The signs − and + refer to samples tested negative or positive by culture recovery and/or nested PCR, respectively.

TABLE 3

| Infection status in deer blood with mutant pool containing Ech_0202, Ech_0601 and Ech_0760[#] Days post infection | | | | | | | | | | | | | | | | | | |
|---|---|---|---|---|---|---|---|---|---|---|---|---|---|---|---|---|---|---|
| Insertion site | 0 | 5 | 6 | 8 | 10 | 14 | 18 | 21 | 28 | 32 | 35 | 39 | 42 | 46 | 49 | 52 | 59 | 63 |
| Ech_0202 | − | − | − | − | − | − | − | − | − | − | − | − | − | − | − | − | − | − |
| Ech_0601 | − | − | + | − | − | + | + | + | + | − | − | − | − | − | − | − | − | + |
| Ech_0760 | − | + | − | − | + | − | + | + | − | − | − | − | − | − | − | − | − | − |

[#]The signs − and + refer to samples tested negative or positive by culture recovery and/or nested PCR, respectively.

Example 4

Needle Infection of *A. americanum* Ticks with Mutants or Wild Type *E. chaffeensis* Cultures for Assessing the Impact of Mutations on *E. chaffeensis* Growth in the Tick Vector

*A. americanum* nymphal ticks experimentally fed and dropped after completing a blood meal from a naïve sheep were used in this study. Fed nymphs were purchased from the Oklahoma State University tick facility. Within 24-48 h post blood meal, nymphs were injected with about 5 μl of 10 fold concentrated cultured *E. chaffeensis* (mutants or wild type). Briefly, culture in PBS was used for needle puncture inoculation into the ventral side of ticks. Ticks were allowed to molt to adults at room temperature. Total genomic DNA from ticks was individually isolated, resuspended into 100 μl of nuclease-free water and 2 μl each of the DNA was used as template for PCR analysis. The presence of *E. chaffeensis* (wild type or mutant organisms) was determined by nested PCR assays as described in Example 1 above.

Infection of *A. americanum* ticks by needle inoculation method with *E. chaffeensis* mutants demonstrated that the mutated genes were essential only for survival in the vertebrate host but not for the organism's persistence in its tick vector. Four groups of engorged nymphal ticks were included in this experiment; group 1 received wild-type *E. chaffeensis*, group 2 received a pool of five mutants grown together (Ech_0230, Ech_0284, Ech_0379, Ech_0480 and Ech_0490), group 3 received an equal mixture of five individually cultured mutants (Ech_0202, Ech_0284, Ech_0379, Ech_0480 and Ech_0660) and group 4 contained five sub-groups inoculated with mutants individually cultured (the same five mutants used in group 3 experiment). Following molting of nymphs to adults, total genomic DNA was recovered from randomly selected ticks of both sexes from each group (14-21 ticks per group/subgroup) and assessed for infection rates by wild type or mutant-specific nested PCR assays, data summarized in Table 4. Infection with wild type *E. chaffeensis* (group 1) was 9.5%. Infection rates with the mutants were variable for each mutant in groups 2-4. The highest infection rate was observed for Ech_0480 mutant and its infection rates were very similar in all three groups of ticks at 50-57%. The Ech_0379 mutant infection in groups 2-4 was also very similar at 28-30%. Ech_0202 infection was undetectable in a pool containing equal mixture (group 3); however, it was detected in one tick in the subgroup of group 4 receiving the mutant alone as the inoculum. These results illustrate the unexpected result that, contrary to the attenuated growth in deer and dogs, Ech_0230, Ech_0379 and Ech_0660 mutants showed no survival disadvantage in ticks.

TABLE 4

| Infection rate of needle injected *A. americanum* ticks | | | | |
|---|---|---|---|---|
| | Group 1 (wild type) | Group 2 (mutant pool) | Group 3 (equal mixture of mutants) | Group 4 (individual mutants) |
| wild type | 9.5% (2/21) | | | |
| Ech_0202 | | | 0% (0/14) | 4.7% (1/21) |
| Ech_0230 | | 20% (4/20) | | |
| Ech_0284 | | 5% (1/20) | 57.1% (8/14) | 23.8% (5/21) |
| Ech_0379 | | 30% (6/20) | 28.5% (4/14) | 28.5% (6/21) |
| Ech_0480 | | 50% (10/20) | 57.1% (8/14) | 57.1% (12/21) |
| Ech_0490 | | 50% (10/20) | | |
| Ech_0660 | | | 7.1% (1/14) | 23.8% (5/21) |

Example 5

Antibody, CD8+, and CD4+ T Cell Responses to Vaccination and Challenge

PBMCs were isolated by density centrifugation from buffy coat fractions of peripheral blood collected into 2× acid citrate dextrose. Cells were washed and resuspended in complete RPMI composed of RPMI-1640 (Gibco, Carlsbad, Calif.) supplemented with 2 mM L-glutamine, 25 mM HEPES buffer, 1% antibiotic-antimycotic solution, 50 mg/mL gentamicin sulfate, 1% nonessential amino acids, 2% essential amino acids, 1% sodium pyruvate, 50 μM 2-mercaptoethanol, and 10% (v/v) fetal bovine serum. For lymphocyte proliferation assays, cells were labeled with 1 μM CellTrace Violet (Life Technologies Inc.) per manufacturer's instructions. Cells were cultured for 5 days at 37° C. with $4\times10^5$ cells/well in 96-well plates and were stimulated with 10 μg/mL host cell-free *E. chaffeensis* whole-cell lysate that was grown in ISE6 tick cells. As a positive control, cells were stimulated with 5 μg/mL Concanavalin A (Sigma-Aldrich). For proliferation and intracellular cytokine staining data, background (mock) responses were subtracted from the response to antigen and results are presented as change over mock.

For surface staining of cells for flow cytometry, cells were resuspended at $10^7$ cells/mL in FACS buffer (0.1% $NaN_3$, 10% fetal calf serum, PBS) and incubated for 20 minutes at 4° C. with 10 μg/mL primary antibodies or as recommended by the manufacturer (mouse anti-canine CD3-FITC (clone CA17.2112), CD4-RPE or APC (clone YKIX302.9), CD8 RPE or APC (YCATE55.9) all from AbD Serotec (Raleigh, N.C.)). Cells were washed and fixed in BD FACS Lysis buffer (BD Biosciences).

Flow cytometry data were collected on a BD LSR Fortessa X-20 flow cytometer and analyzed using FlowJo software (Tree Star Inc., San Carlos, Calif.). Antigen-dependent $CD4^+$ T cells were identified based upon proliferation in response to *E. chaffeensis* antigen as determined by dilution of the Cell Trace Violet dye.

Figure 3A:
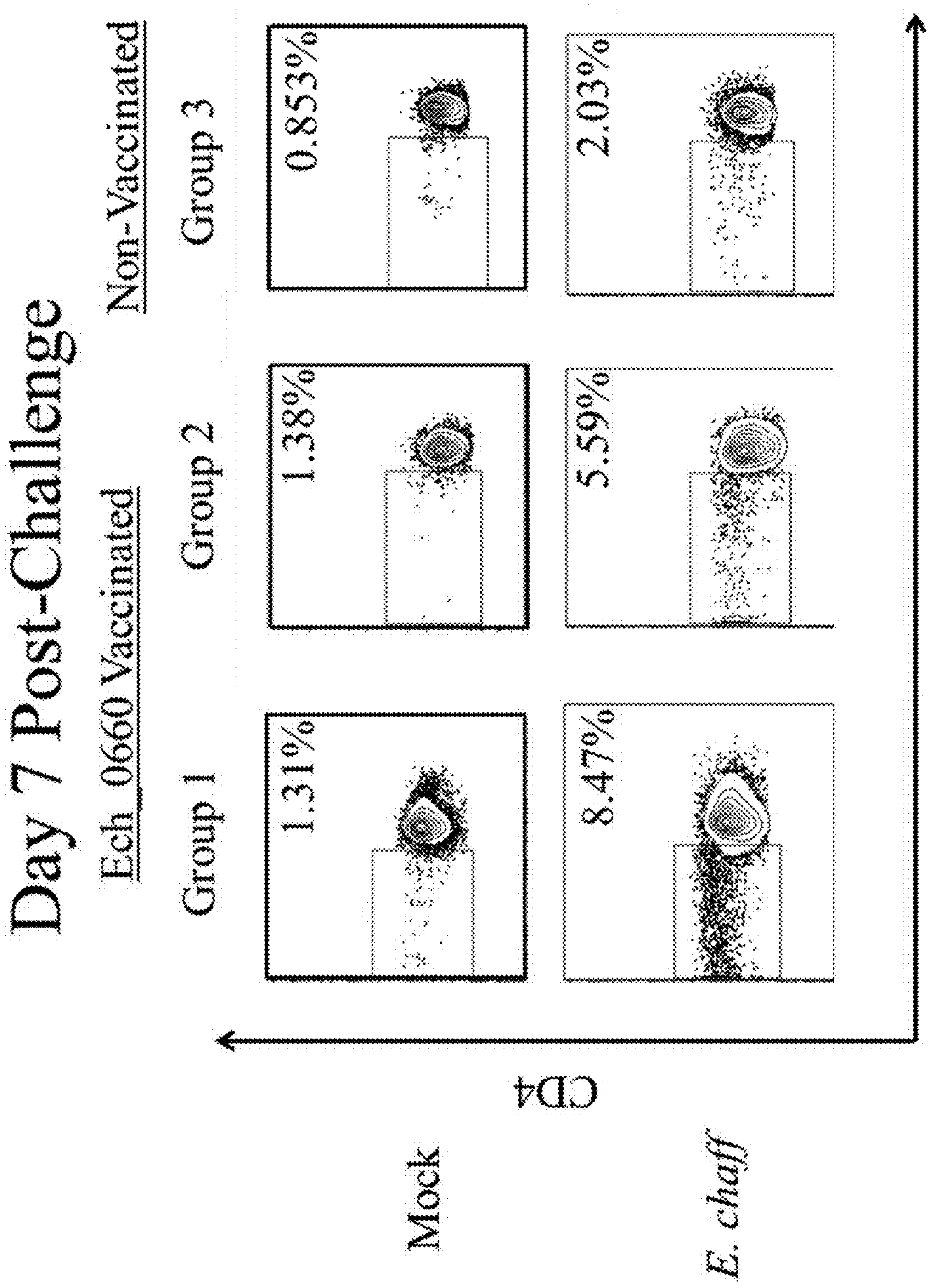
FIG. 3A shows representative Cell Trace Violet dilution profiles, gated on total live cells and total $CD3^+CD4^+$ T cells.
Figure 3B:
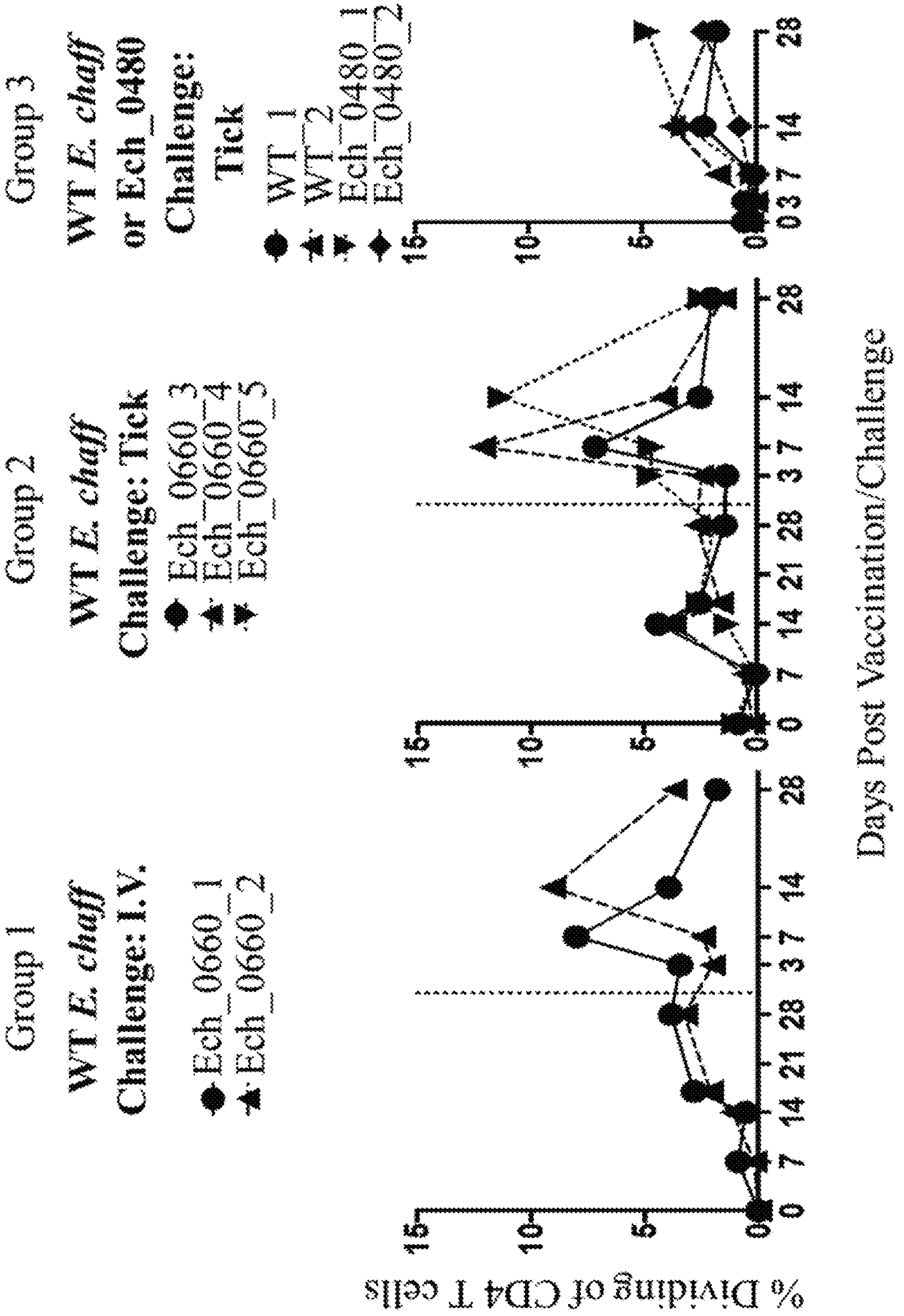
FIG. 3B shows the percentage of $CD4^+$ T cells that have proliferated in response to *E. chaffeensis* antigens as measured over the course of the experiment. Each line is representative of a single animal.

We next measured *E. chaffeensis*-specific $CD4^+$ T cell recall responses in peripheral blood from vaccinated and control dogs. PBMC were labeled with Cell Trace Violet, stimulated with host cell-free *E. chaffeensis* whole cell lysate and then analyzed by flow cytometry. Antigen-dependent $CD4^+$ T cells were identified based upon proliferation in response to *E. chaffeensis* antigen as determined by dilution of the Cell Trace Violet dye. Data in FIGS. 3A and 3B represent PBMC from dogs vaccinated with Ech_0660 and challenged with wild-type *E. chaffeensis* via needle inoculation (group 1, left panels), vaccinated with Ech_0660 and challenged with wild-type *E. chaffeensis* via tick inoculation (group 2, middle panels), or unvaccinated and infected with wild-type *E. chaffeensis* or Ech_0480 via tick inoculation (group 3, right panels) were labeled with Cell Trace Violet, then cultured for 5 days at $4\times10^6$ cells/mL in the presence or absence of 10 ug/mL *E. chaffeensis* host-cell free lysate grown in the tick ISE6 cell line. On day 5, $CD4^+$ T cells were analyzed by flow cytometry for Cell Trace Violet dilution as a measure of proliferation. FIG. 3A shows representative dilution profiles of mock and antigen-stimulated $CD4^+$ T cells from one representative animal per group on day 7 post-secondary challenge. The numbers depicted in FIG. 3A represent the percent of proliferating $CD3^+CD4^+$ cells contained within each gate. FIG. 3B shows the percentage of $CD4^+$ T cells dividing in response to antigen that was measured in all animals over the course of the experiment. Background levels of proliferation were subtracted from these values and results represent change in proliferation over mock stimulated cultures.

We observed an increase in the percentage of $CD4^+$ T cells that divided in response to *E. chaffeensis* antigen in PBMC collected on day 14-17 post inoculation with the Ech_0660 mutant. This percentage was further increased on day 7-14 following wild type *E. chaffeensis* challenge, consistent with a recall response. Vaccinated animals displayed significantly higher percentages of proliferating *E. chaffeensis* antigen-dependent $CD4^+$ T cells compared to unvaccinated dogs (FIG. 3B, p=0.0081).

We also measured antigen-dependent IFNγ production by $CD4^+$ T cells in the blood using intracellular cytokine staining. Protocol for harvest and surface staining was performed as described above with the addition of mouse-anti-bovine IFNγ-RPE (clone CC302) also from AbD Serotec (Raleigh, N.C.). The bovine IFNγ-specific clone CC302 has been previously demonstrated to cross-react with canine IFNγ. Intracellular cytokine staining for IFNγ was carried out using the BD Fixation and Permeabilization Solution kit (BD Biosciences). Cells were cultured with antigen for 5 days, and then Brefeldin A was added for the last 5-6 hours of incubation. Cells were surface stained and then fixed, permeabilized and stained for intracellular IFNγ (Clone CC302, 10 μg/mL) per manufacturer's instructions.

Figure 4A:
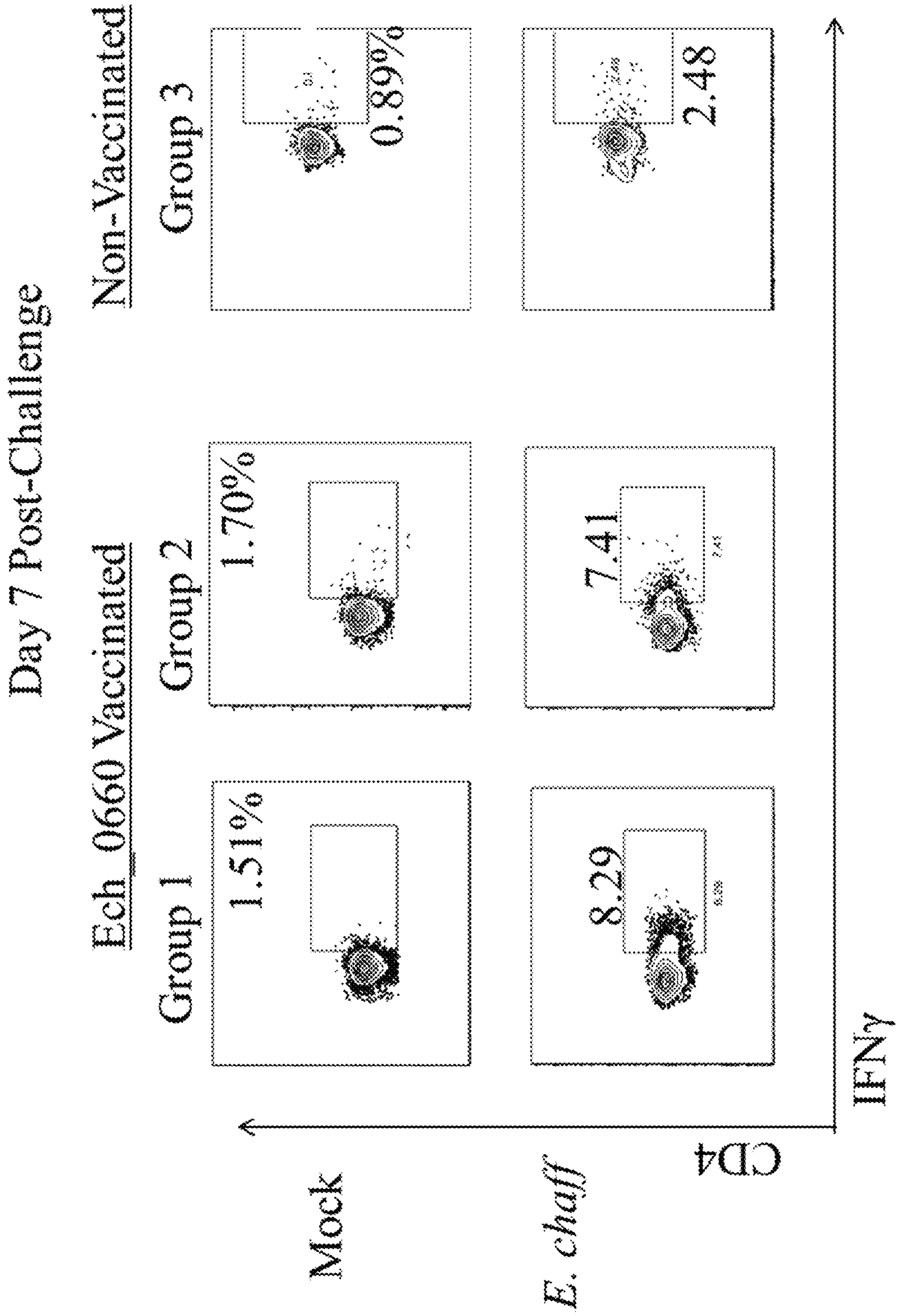
FIG. 4A shows representative flow plots of mock and antigen-stimulated $CD4^+$ T cells gated on $IFN\gamma^+$ cells from animals in groups 1, 2 and 3, gated on total live cells and total $CD3^+CD4^+$ T cells.
Figure 4B:
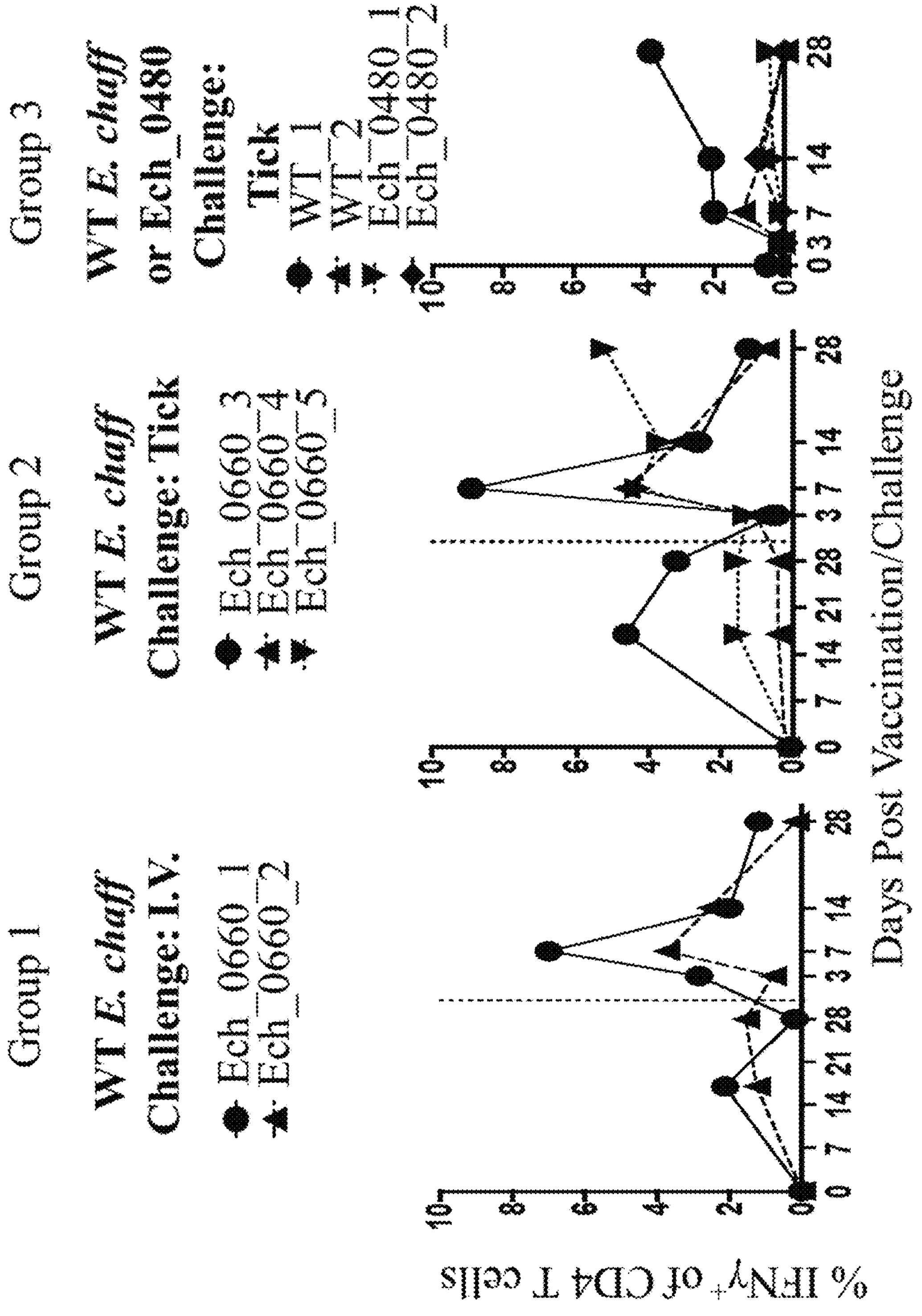
FIG. 4B shows the percentage of $IFN\gamma^+$ cells of total $CD4^+$ T cells in the blood.

FIG. 4 presents PBMC from dogs vaccinated with the Ech_0660 mutant and challenged with wild-type *E. chaffeensis* (groups 1-3, as in FIG. 2) were cultured for 5 days at $4\times10^6$ cells/mL in the presence or absence of 10 ug/mL *E. chaffeensis* host-cell free lysate grown in the tick ISE6 cell line. On day 5, brefeldin A was added for the last 6 hours of culture. $CD4^+$ T cells were stained for intracellular expression of IFNγ and analyzed by flow cytometry. FIG. 4A shows representative flow plots of mock and antigen-stimulated $CD4^+$ T cells gated on $IFN\gamma^+$ cells from animals in groups 1, 2 and 3, gated on total live cells and total $CD3^+CD4^+$ T cells. FIG. 4B shows the percentage of $IFN\gamma^+$ cells of total $CD4^+$ T cells in the blood measured over the course of the experiment. Background was subtracted from mock stimulated samples as above. We observed significantly increased percentages of $CD4^+$ T cells producing IFNγ in response to *E. chaffeensis* antigen in samples from vaccinated animals, compared to unvaccinated controls (FIG. 4B, p=0.0025).

Figure 5A:
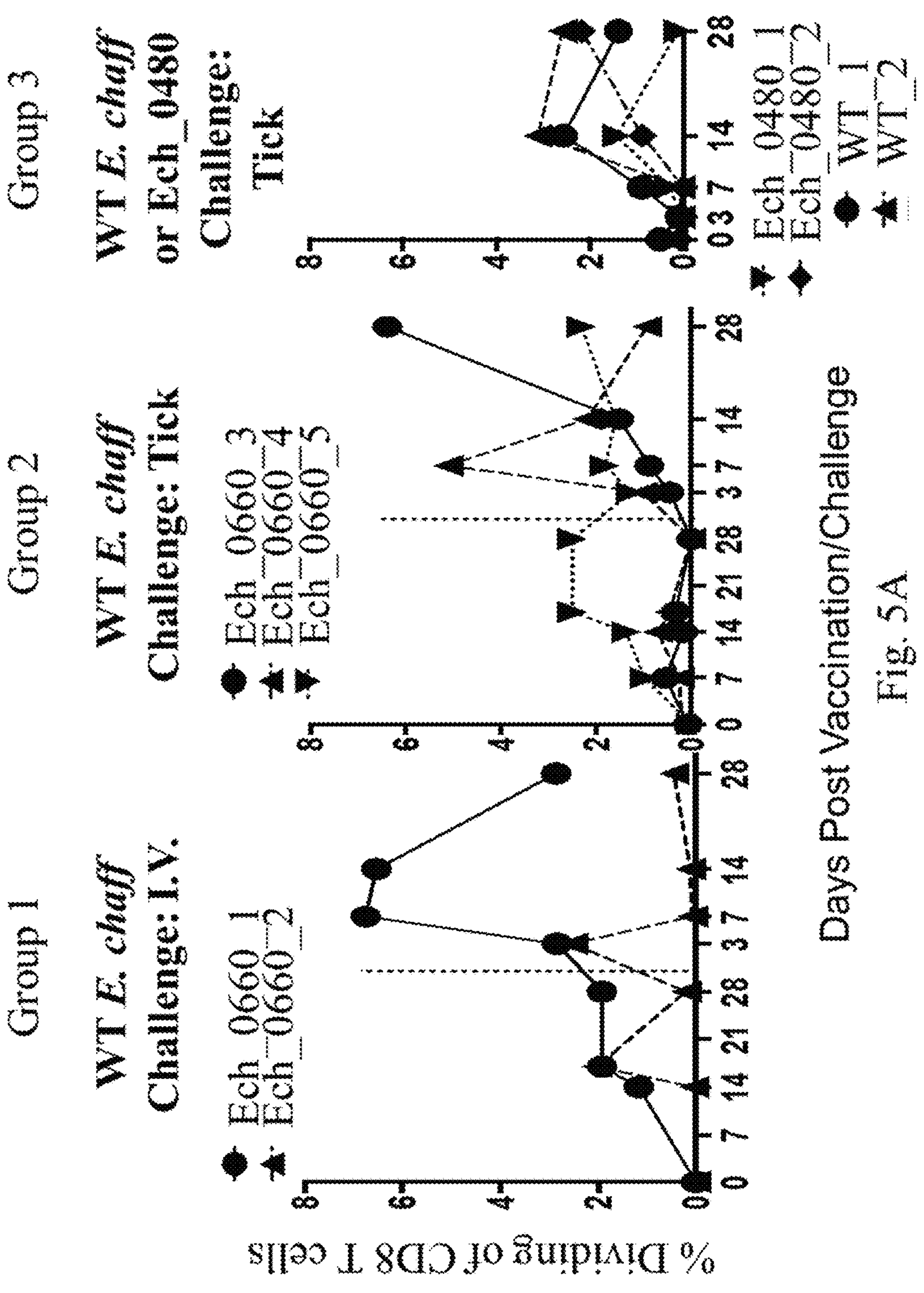
FIG. 5A shows data from $CD8^+$ T cells were analyzed by flow cytometry for proliferation as measured by Cell Trace Violet dilution at day 5 of culture.
Figure 5B:
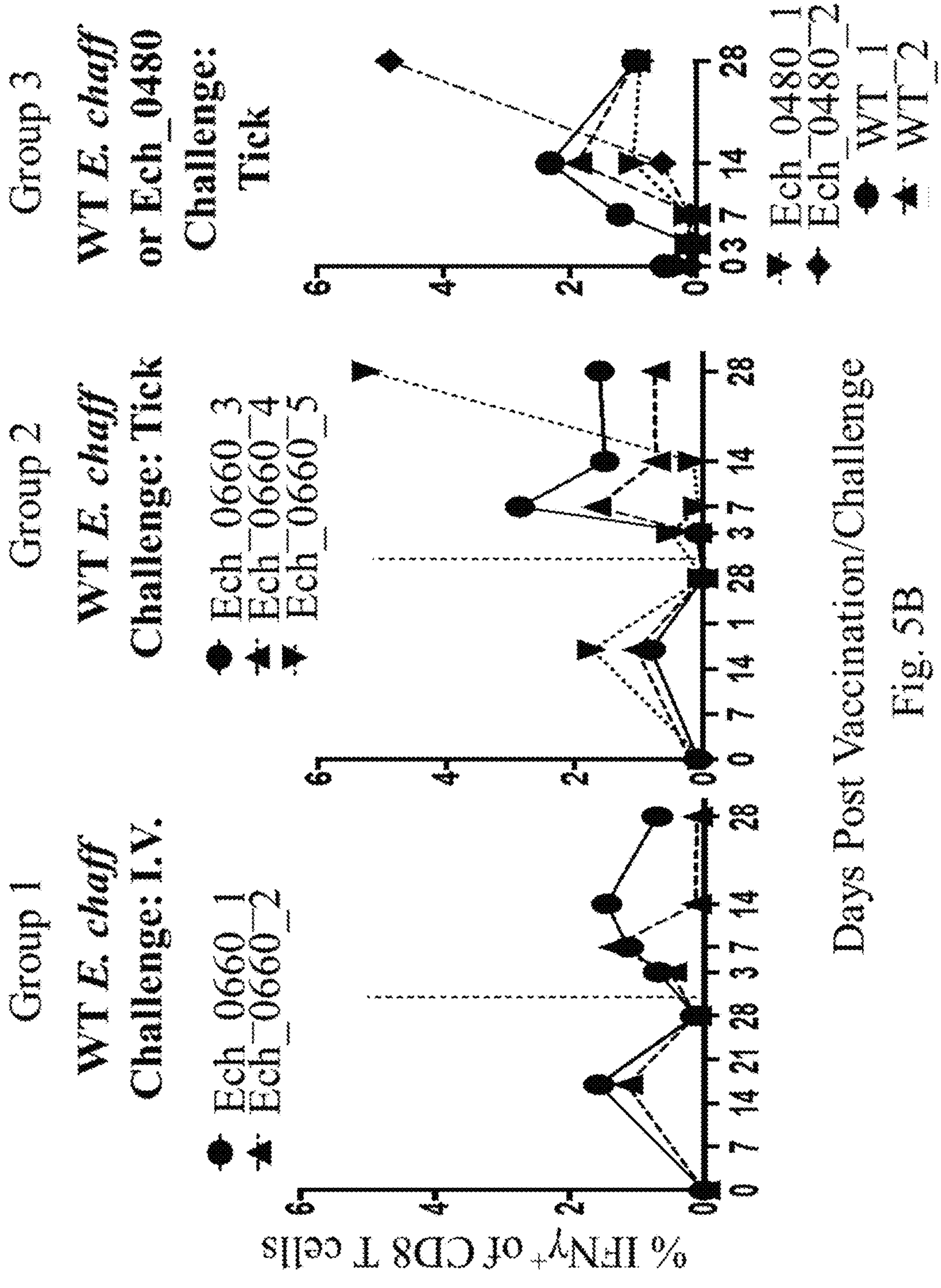
FIG. 5B shows data from intracellular production of IFNγ at day 5.

FIG. 5 presents $CD8^+$ T cell proliferation and IFNγ production were measured using similar approaches as in FIGS. 3 and 4. PBMC from dogs in groups 1-3 were cultured for 5 days at $4\times10^6$ cells/mL in the presence or absence of 10 ug/mL *E. chaffeensis* host-cell free lysate. On day 5 of culture, $CD8^+$ T cells were analyzed by flow cytometry for proliferation as measured by Cell Trace Violet dilution, illustrated in FIG. 5A; and intracellular production of IFNγ, illustrated in FIG. 5B. The frequencies of responding $CD8^+$ T cells were measured over the course of the experiment. Results were gated on total live cells and total $CD3^+CD8^+$ T cells. Background was subtracted as above.

Neither vaccination nor infection with wild type *E. chaffeensis* induced a significant $CD8^+$ T cell response as measured by proliferation or IFNγ.

ELISAs were performed to measure cytokines using PBMC culture supernatants collected after 5 days of stimulation with 10 μg/mL host-cell free *E. chaffeensis* lysate. IL-4, IFNγ, and IL-17A protein concentrations were determined by commercial ELISA kit (R&D Systems, Minneapolis, Minn.) per manufacturer's instructions to measure Th1, Th2 and Th17 cytokines secreted by PBMC in recall responses to *E. chaffeensis* antigen.

Figure 6:
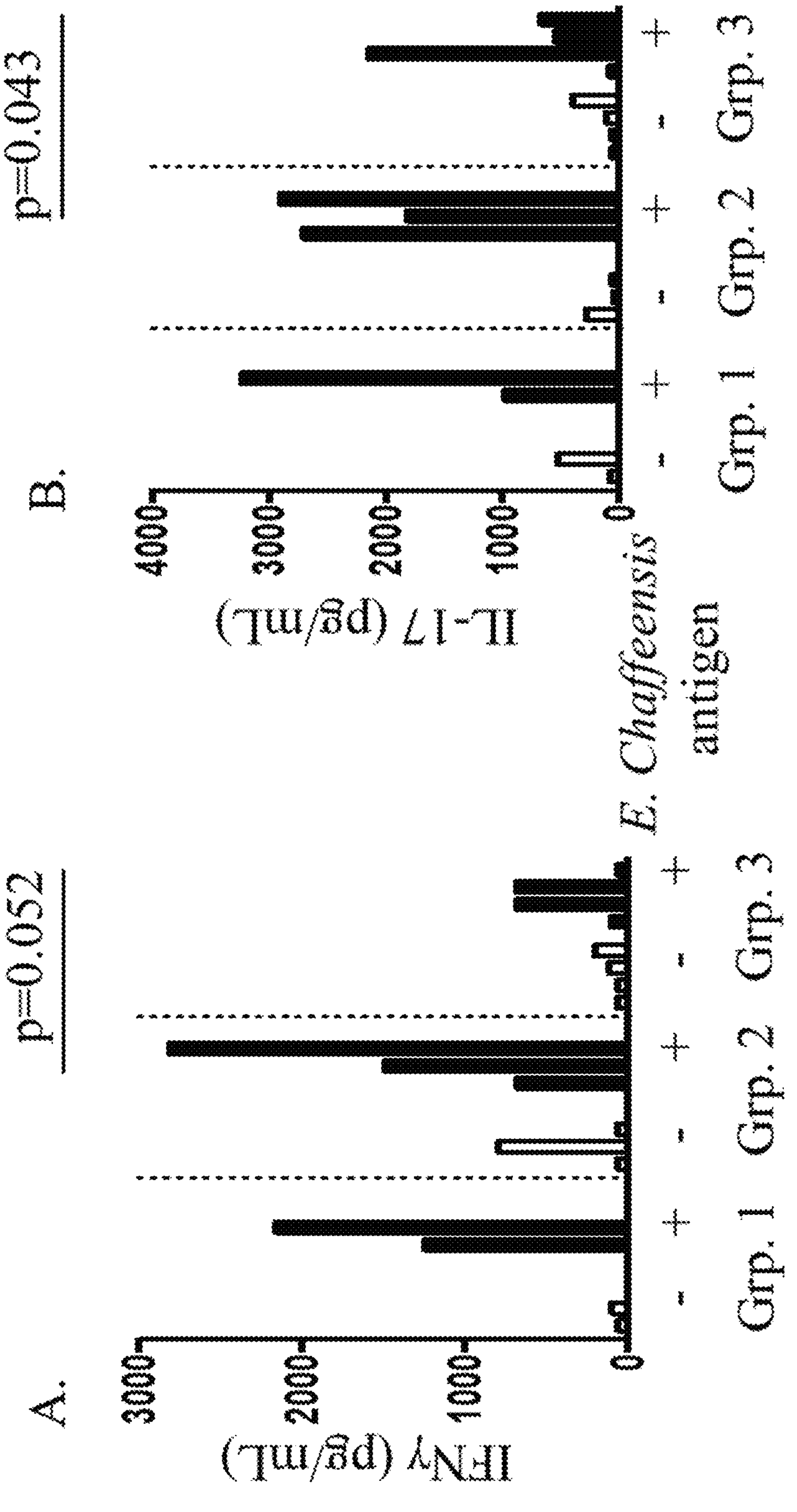
FIG. 6 is data from cell culture supernatants collected and analyzed by Enzyme-linked immunosorbent assay (ELISA) measuring PBMC production of (A) IFNγ and (B) IL-17 following vaccination, challenge, and +/−stimulation with host-cell free *E. chaffeensis* lysate.

FIG. 6 presents PBMC from dogs vaccinated with Ech_0660 and challenged with wild-type *E. chaffeensis* (groups 1-3, as in FIG. 2) were collected on day 7 post-secondary challenge with wild-type *E. chaffeensis*. PBMC were cultured for 5 days at $4\times10^6$ cells/mL in the presence or absence of 10 ug/mL *E. chaffeensis* host-cell free lysate grown in the tick ISE6 cell line. On day 5, cell culture supernatants were collected and later analyzed by ELISA for secretion of (A) IFNγ, (B) IL-17, and IL-4 (not shown). Each bar is representative of a single animal.

PBMC from Ech_0660 vaccinated animals secreted IFNγ (Th1) in response to *E. chaffeensis* antigen (FIG. 6A); and this response was significantly increased over the response from unvaccinated control dogs. We did not observe appreciable IL-4 (Th2) production by PBMC from vaccinated or control dogs (data not shown); however, all three groups mounted a vigorous IL-17 response to *E. chaffeensis* antigen (FIG. 6B). IL-17 production by cells from Ech_0660 vaccinated dogs was significantly increased over unvaccinated controls.

Example 6

Attenuated Mutants Confer Protection Against Wild Type Infection Challenge in Deer and Dogs We reasoned that the attenuation in vertebrate hosts with three gene disruption mutations is the result of the pathogen's inability to maintain replication cycle continuously. We then hypothesized that the attenuated mutants induce sufficient host response to protect against infection challenge with wild type *E. chaffeensis*. We tested this hypothesis with two clonally purified attenuated mutants with insertions within Ech_0379 and Ech_0660 genes, as these mutations caused the loss of gene activity from putative $Na^+/H^+$ antiporter and phage like structure protein, respectively. Five groups of deer were used (three animals each in groups 1, 3 and 4, and two animals each in groups 2 and 5): group 1 received wild type *E. chaffeensis* infection; group 2 received clonally purified Ech_0284 mutant, as it is similar to wild type in causing persistent infection and can serve as a syngeneic positive control for other mutants; groups 3 and 4 received infections with clonally purified Ech_0379 and Ech_0660 mutants, respectively; and group 5 received no infection to serve as non-infection controls. Infection in all five groups was monitored in blood sampled frequently for 31-41 days and by performing nested PCRs on DNA recovered or by culture recovery method (Table 5). Infection was detected frequently and persisted very similar in groups 1 and 2 animals (59% and 61% of the samples tested positive, respectively), while detected less frequently (19% of the time) in Ech_0379 mutant infected (group 3) animals; detected in one animal on day 4 and 28, on day 35 in the second animal, and on day 7 in the third animal. Infection was undetectable throughout the study in group 4 (Ech_0660 mutant group) and group 5 deer (controls).

TABLE 5

White tailed deer Infection status with three different clonally purified mutants or with wild type *E. chaffeensis*[#]
Days post infection*

| | | | | | | | | | | | |
|---|---|---|---|---|---|---|---|---|---|---|---|
| | | 0 | 4 | 11 | 18 | 22 | 24 | 27 | 30 | 37 | 41 |
| Group 1 | wt-1 | − | − | + | + | + | + | + | + | + | + |
| | wt-2 | − | − | − | − | + | + | + | + | + | − |
| | wt-3 | − | + | − | − | − | + | + | − | − | − |
| | | 0 | 3 | 5 | 8 | 10 | 14 | 21 | 23 | 28 | 31 |
| Group 2 | Ech_0284-1 | − | − | + | + | + | + | + | − | − | − |
| | Ech_0284-2 | − | − | − | + | + | + | + | + | − | + |
| | | 0 | 4 | 7 | 12 | 14 | 21 | 28 | 35 | | |
| Group 3 | Ech_0379-1 | − | + | − | − | − | − | + | − | | |
| | Ech_0379-2 | − | − | − | − | − | − | − | + | | |
| | Ech_0379-3 | − | − | + | − | − | − | − | − | | |
| | | 0 | 3 | 5 | 8 | 10 | 14 | 21 | 23 | 28 | 31 |
| Group 4 | Ech_0660-1 | − | − | − | − | − | − | − | − | − | − |
| | Ech_0660-2 | − | − | − | − | − | − | − | − | − | − |
| | Ech_0660-3 | − | − | − | − | − | − | − | − | − | − |
| Group 5 | Control-1 | − | − | − | − | − | − | − | − | − | − |
| | Control-2 | − | − | − | − | − | − | − | − | − | − |

[#]The signs − and + refer to samples tested negative or positive by culture recovery and/or nested PCR, respectively.
*Samples were collected on different days post infection for each group.

Total average positives in groups 1-5 are 59%, 61%, 19%, 0% and 0%, respectively (0 day data were not included in this calculation).

Plasma samples from all deer in groups 1-5 were evaluated by ELISA for the total IgG antibody response against *E. chaffeensis* whole cell antigens (FIG. 7).

ELISA was performed using a preparation of host cell-free *E. chaffeensis* lysate. Plasma samples from deer or dogs collected prior to infection and several days following infections were assessed by ELISA for the presence of the pathogen-specific IgG.

Figure 7A:
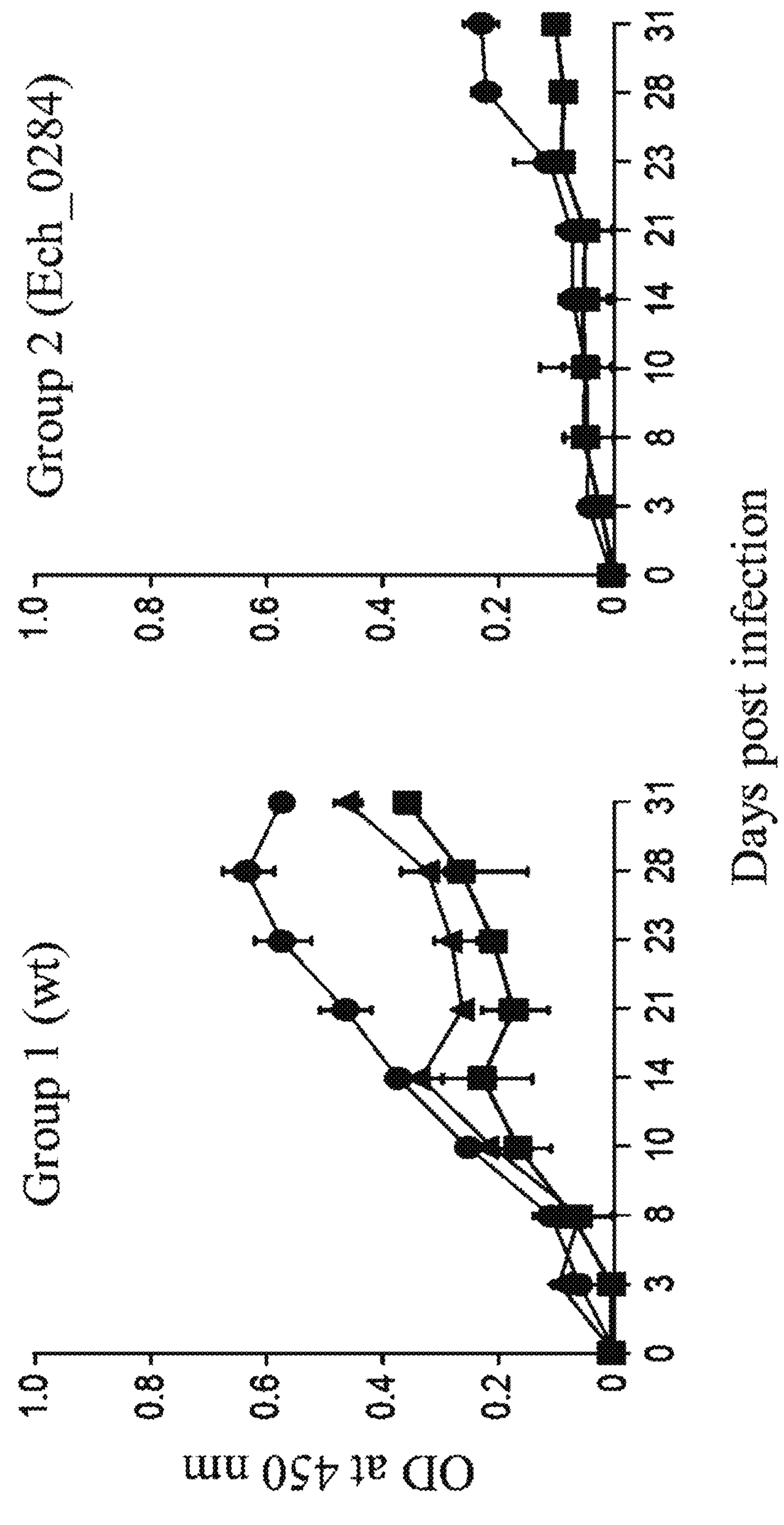
FIG. 7A shows data from an ELISA measuring Pathogen-specific total IgG response in deer infection following vaccination, challenge, and +/−stimulation with host-cell free *E. chaffeensis* lysate for wild type *E. chaffeensis* or mutant Ech_0284.
Figure 7B:
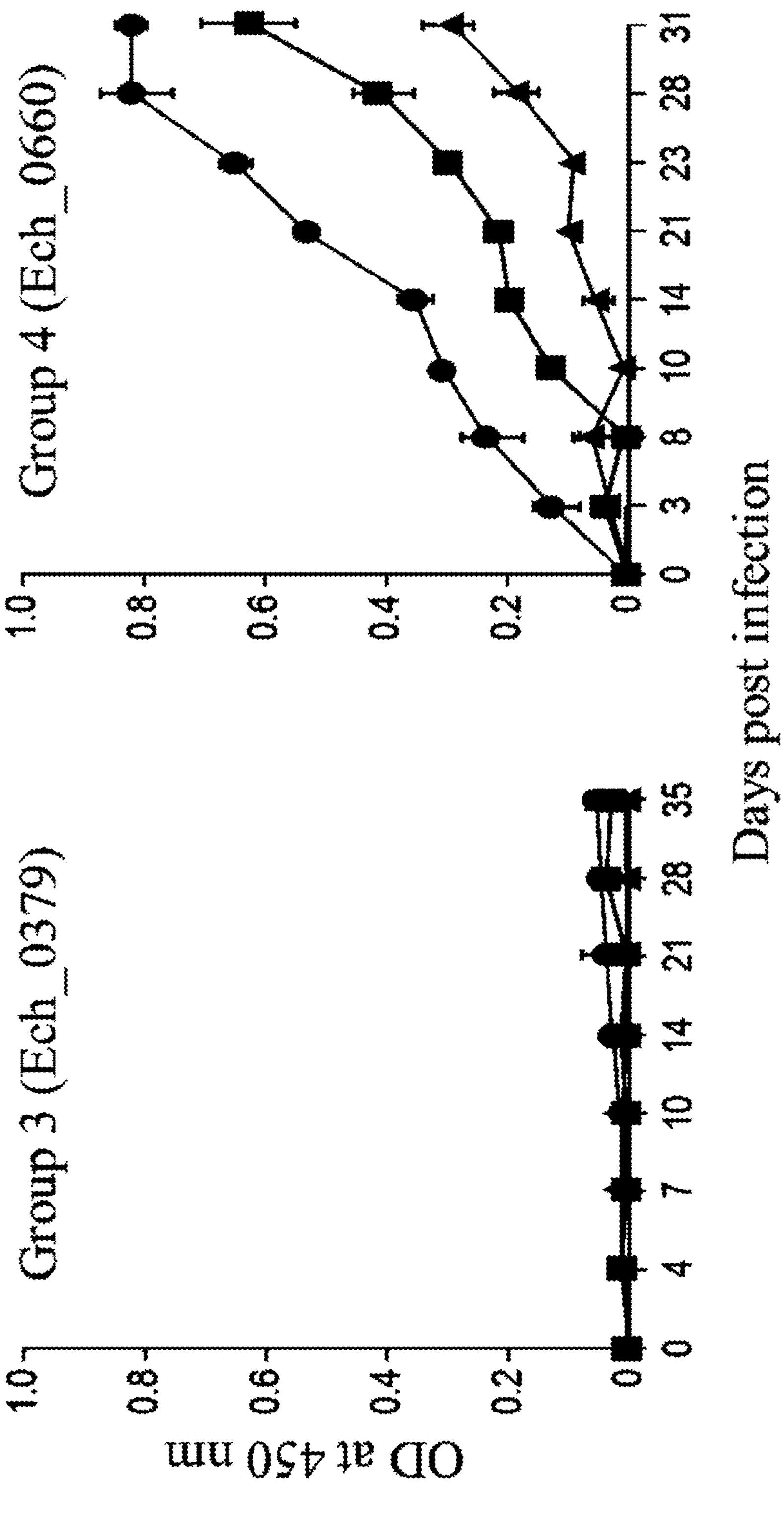
FIG. 7B shows data from an ELISA measuring Pathogen-specific total IgG response in deer infection following vaccination, challenge, and +/−stimulation with host-cell free *E. chaffeensis* lysate for mutant Ech_0379 or Ech_0660.
Figure 7C:
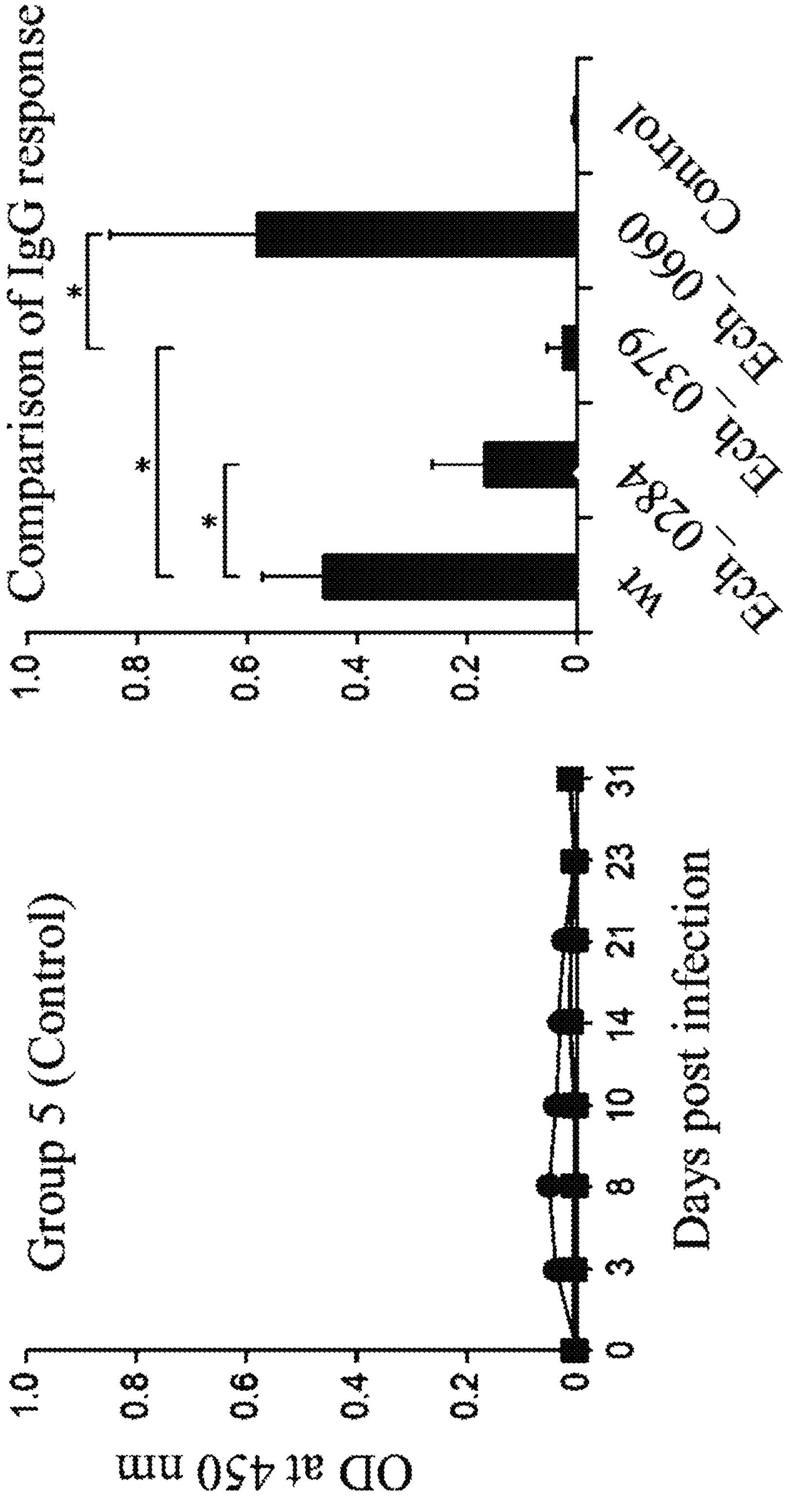
FIG. 7C shows data from an ELISA measuring Pathogen-specific total IgG response in deer infection following vaccination, challenge, and +/−stimulation with host-cell free *E. chaffeensis* lysate for the control, and a graph including comparison of the IgG responses.

FIGS. 7A-7C present *E. chaffeensis*-specific IgG response in deer infected with wild-type and mutant *E. chaffeensis*. Groups 1-5 represent the ELISA analysis performed on animals infected with wild-type, Ech_0284, Ech_0379, Ech_0660 and non-infected controls, respectively. Line graphs within each group represent the IgG responses for individual animals {data presented as mean values ±standard deviation (SD) from triplicate samples}. In FIG. 7C, the comparison of IgG data for each group for the last day of sample analysis is shown on the right. Significant IgG differences ($P \leq 0.05$) observed between groups are identified with asterisks. Error bars for this graph represent mean values ±SD for animals within each group.

Deer in groups 1 and 4 (wild type and Ech_0660 mutant infected groups, respectively) had IgG responses, whereas the Ech_0379 infected group 3 and control group 5 had no IgG responses. The Ech_0284 infected group 2 had a weaker response. The IgG levels are higher in wild type infected group which steadily increased with time post infection. The IgG responses were similar for wild type and Ech_0660 infected animals. The IgG levels for these two groups were not significantly different, as judged by comparing the IgG data for each group for the last day of the sample analysis, while IgG in Ech_0284 and Ech_0379 mutant infected animals were significantly lower compared to wild type. Similarly, Ech_0379 and Ech_0660 mutant infected animals differed significantly ($P \leq 0.05$).

To determine if the Ech_0379 and Ech_0660 mutants confer protection, deer infected with these mutants (groups 3 and 4, respectively) were intravenous infection challenged with wild type *E. chaffeensis* after about a month and the infection was monitored in blood by nested PCR and by in vitro culture recovery methods for 32 days (group 3) or 44 days (group 4) (Table 6). To serve as a positive control, infection in deer with the wild type *E. chaffeensis* infection (group 1 above) was carried out with this challenge experiment using the inoculum used from same batch of culture. All three challenged animals in the Ech_0660 group tested negative for the organism for the entire 44 days, while one animal in the Ech_0379 group tested positive on day 7 post challenge (Table 6). In toto, prior exposure of animals with the attenuated mutants; Ech_0379 or Ech_0660, reduced *E. chaffeensis* circulating in blood when challenged with wild type organisms. Tissue samples (liver and spleen) collected at the end point of the study were assessed for the presence of *E. chaffeensis* by nested PCR. DNA was isolated from about 20 mg each of a tissue sample and nested PCR assays were performed as described above in Example 1 above.

TABLE 6

Assessing Ech_0379 and Ech_0660 mutant in conferring protection against *E. chaffeensis* challenge in white-tailed deer[#]
Days post challenge

| | | 4 | 7 | 12 | 19 | 23 | 32 |
|---|---|---|---|---|---|---|---|
| Group 3 | Ech_0379-1 | − | + | − | − | − | − |
| | Ech_0379-2 | − | − | − | − | − | − |
| | Ech_0379-3 | − | − | − | − | − | − |

| | | 4 | 11 | 18 | 22 | 24 | 27 | 30 | 34 | 37 | 41 | 44 |
|---|---|---|---|---|---|---|---|---|---|---|---|---|
| Group 4 | Ech_0660-1 | − | − | − | − | − | − | − | − | − | − | − |
| | Ech_0660-2 | − | − | − | − | − | − | − | − | − | − | − |
| | Ech_0660-3 | − | − | − | − | − | − | − | − | − | − | − |

[#]The signs − and + refer to samples tested negative or positive by culture recovery and/or nested PCR, respectively.

Figure 8A:
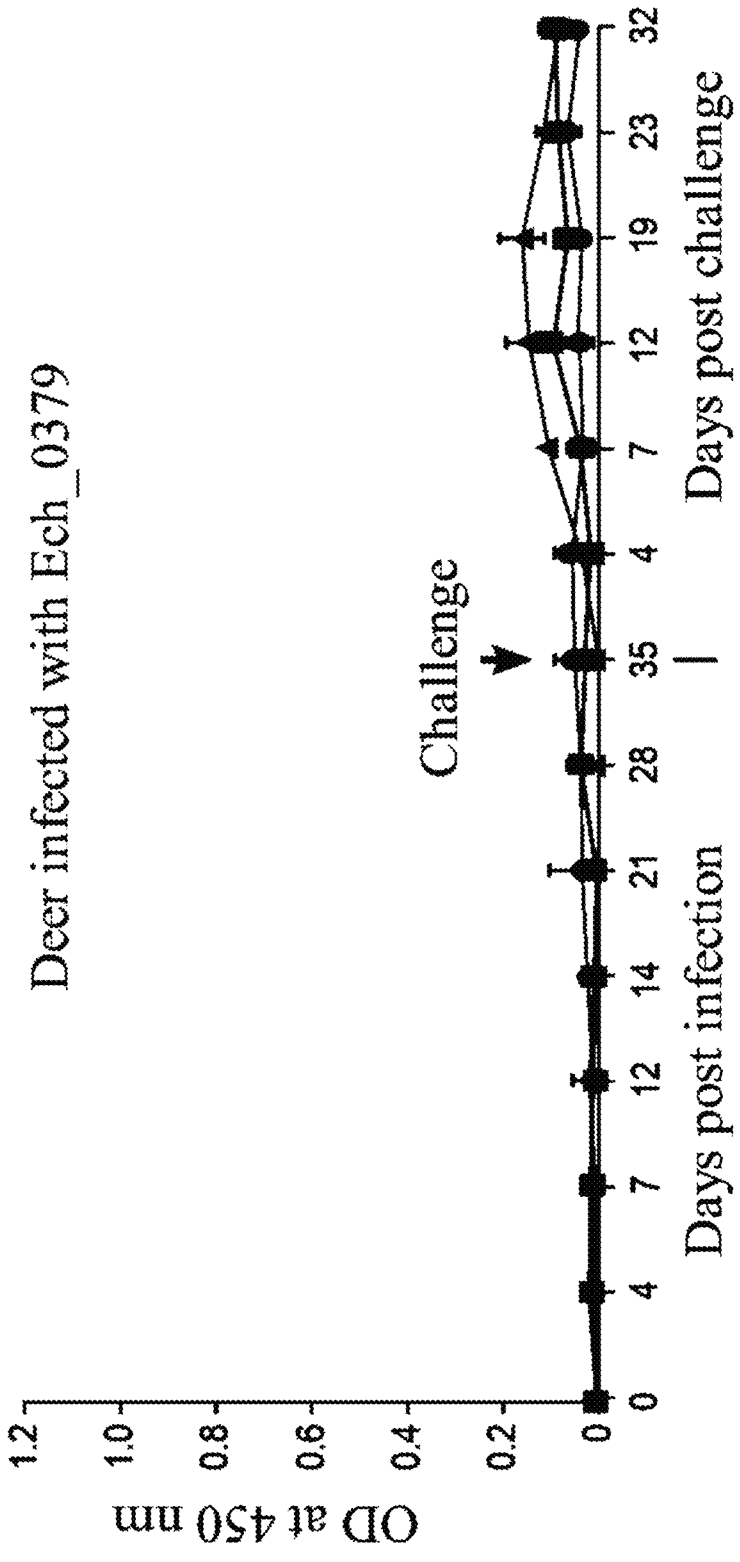
FIG. 8A is data from an ELISA measuring Pathogen-specific total IgG response in deer following vaccination and subsequent challenge for Ech_0379.
Figure 8B:
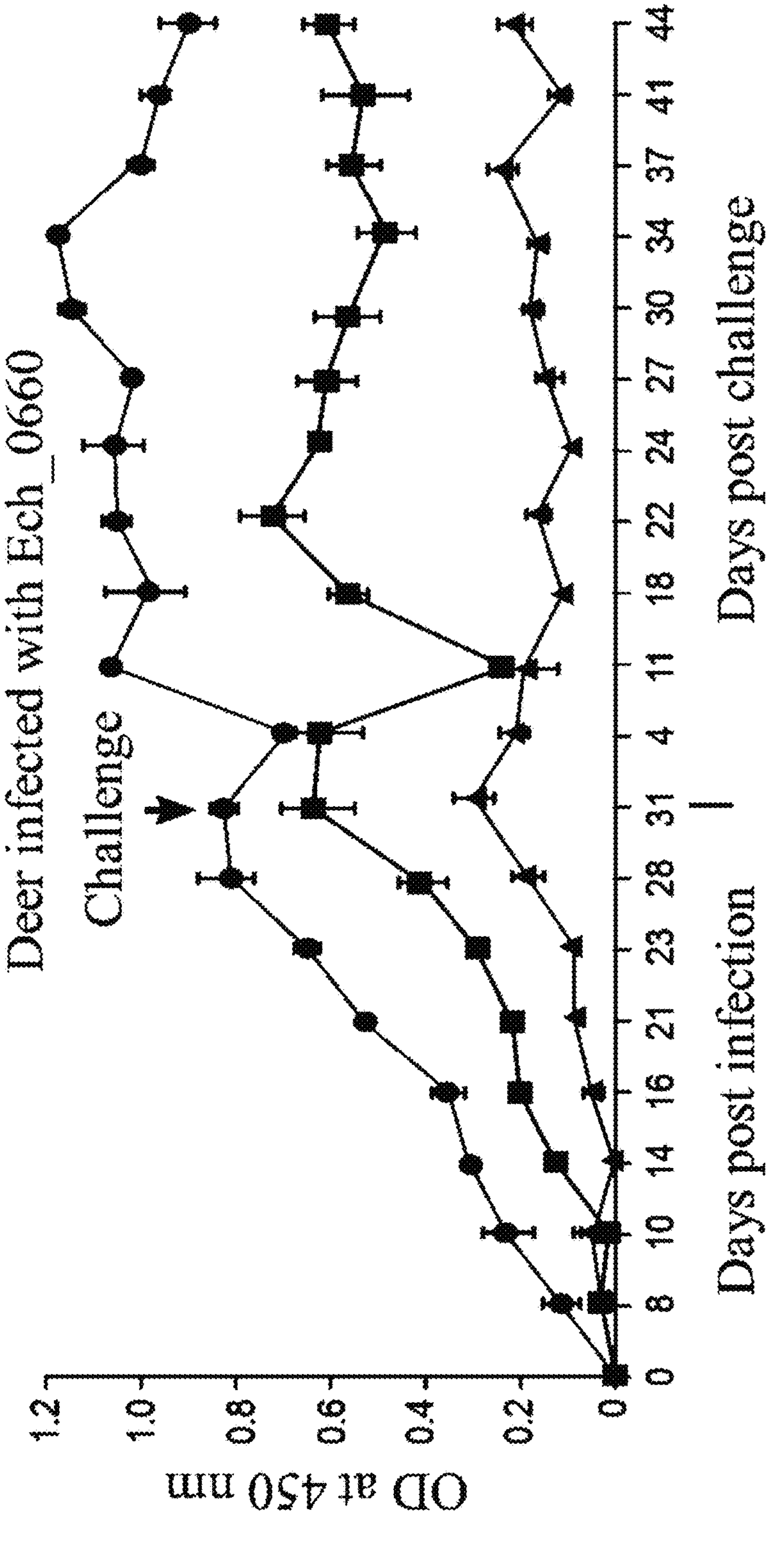
FIG. 8B is data from an ELISA measuring Pathogen-specific total IgG response in deer following vaccination and subsequent challenge for Ech_0660.

Animals in group 4 (Ech_0660 group) and non-infected controls (group 5) tested negative, while deer in groups 1 and 3 (wild type and Ech_0379 groups) tested positive in one or both tissues (Table 7, annotated as above). The group 3 (Ech_0379 group) animals receiving *E. chaffeensis* challenge had a very little change in the antibody response, while two of the three challenged animals in group 4 (Ech_0660 group) had a steady rise in the antibody response (FIG. 8). Specifically, FIGS. 8A-8B present *E. chaffeensis*-specific IgG changes in deer receiving Ech_0379 (FIG. 8A) or Ech_0660 (FIG. 8B) mutant followed by challenge with wild-type infection. IgG levels were assessed in animals receiving mutant inoculated and challenged with wild-type for several days post infection. The data were plotted as in FIG. 3. The day of challenge is identified with down arrows.

TABLE 7

Infection status of tissue samples in deer (Note: the deer numbers are the same as in Table 5)[#]

| | Deer Group | | | | | | | | | | |
|---|---|---|---|---|---|---|---|---|---|---|---|
| | 1 (wild type) | | | 3 (Ech_0379) | | | 4 (Ech_0660) | | | 5 (Control) | |
| Tissue | 1 | 2 | 3 | 1 | 2 | 3 | 1 | 2 | 3 | 1 | 2 |
| Spleen | + | + | − | + | + | − | − | − | − | − | − |
| Liver | + | + | + | + | − | − | − | − | − | − | − |

[#]The − and + signs refer to samples tested negative or positive by nested PCR, respectively.

The infection and challenge experiment was repeated in dogs using mutant/vaccine candidates Ech_0379 and Ech_0660. Tick transmission protocol was performed as follows. *E. chaffeensis* infected *A. americanum* adult ticks were used for the tick-transmitted challenge. The tick infection was conducted as previously described. Briefly, nymphal ticks were needle-inoculated with 5 μl of concentrated bacterial culture containing of ~5,000 wild-type *E. chaffeensis* or virulent Ech_0480 mutant. Nymphs were allowed to molt into adults at room temperature in a humidified chamber with 14 h daylight and 10 h darkness cycles. The infection status of the needle-inoculated ticks was verified by nested PCR targeting to the Ech_1136 gene encoding for the p28-Omp 14 protein as previously described. A small area on the back of the dog was shorn and a tick containment cell was affixed. Twenty-five pairs of adult ticks per dog were placed in the tick containment cell and permitted to feed for 6-7 days before removal.

Two dogs each were infected with the two mutants or with wild type *E. chaffeensis* and two dogs were kept as uninfected controls. Infection with wild type and uninfected controls were as previously described. Infection in blood was monitored by nested PCR and culture recovery methods. The wild type *E. chaffeensis* infected dogs were persistently positive (83% of the time), while the uninfected controls tested negative for the same time period. One dog receiving infection with the Ech_0379 mutant tested positive on days 3, 7 and 10 and the second dog tested positive on days 3, 10, 15, 30, 32 and 35 (Table 8).

TABLE 8

Assessing Ech_0379 and Ech_0660 mutants in conferring protection against wild type *E. chaffeensis* challenge in dogs[#]

| | Days Post Infection | | | | | | | | | | | Days Post Challenge | | | | | |
|---|---|---|---|---|---|---|---|---|---|---|---|---|---|---|---|---|---|
| | 0 | 3 | 7 | 10 | 15 | 18 | 22 | 24 | 30 | 32 | 35* | 2 | 8 | 10 | 17 | 24 | 31 | 38 |
| Ech_0379-1 | − | + | + | + | − | − | − | − | − | − | − | + | + | + | − | − | − | − |
| Ech_0379-2 | − | + | − | + | + | − | − | − | + | + | + | − | + | + | + | − | − | − |

| | 0 | 5 | 7 | 9 | 12 | 14 | 16 | 19 | 21 | 26 | 29* | 5 | 8 | 10 | 14 | 20 | 22 | 28 | 35 | 42 | 49 | 56 | 64 |
|---|---|---|---|---|---|---|---|---|---|---|---|---|---|---|---|---|---|---|---|---|---|---|---|
| Ech_0660-1 | − | + | + | − | − | − | − | − | − | − | + | + | − | − | − | − | − | − | − | − | − | − | − |
| Ech_0660-2 | − | − | + | − | − | − | − | − | − | − | − | − | − | − | − | − | − | − | + | − | − | − | − |

[#]The signs − and + refer to samples tested negative or positive by culture recovery and/or nested PCR, respectively.

Both the dogs receiving Ech_0660 mutant infection tested positive only for the first week after receiving the inoculum (positives detected on days 2 and 7 for one dog and day 7 for the second dog) (Table 8). One dog infected with Ech_0660 mutant also tested positive by culture recovery on day 29 post infection. Dogs infected with Ech_0379 and Ech_0660 mutants were challenged after about a month with wild type *E. chaffeensis*.

Figure 9A:
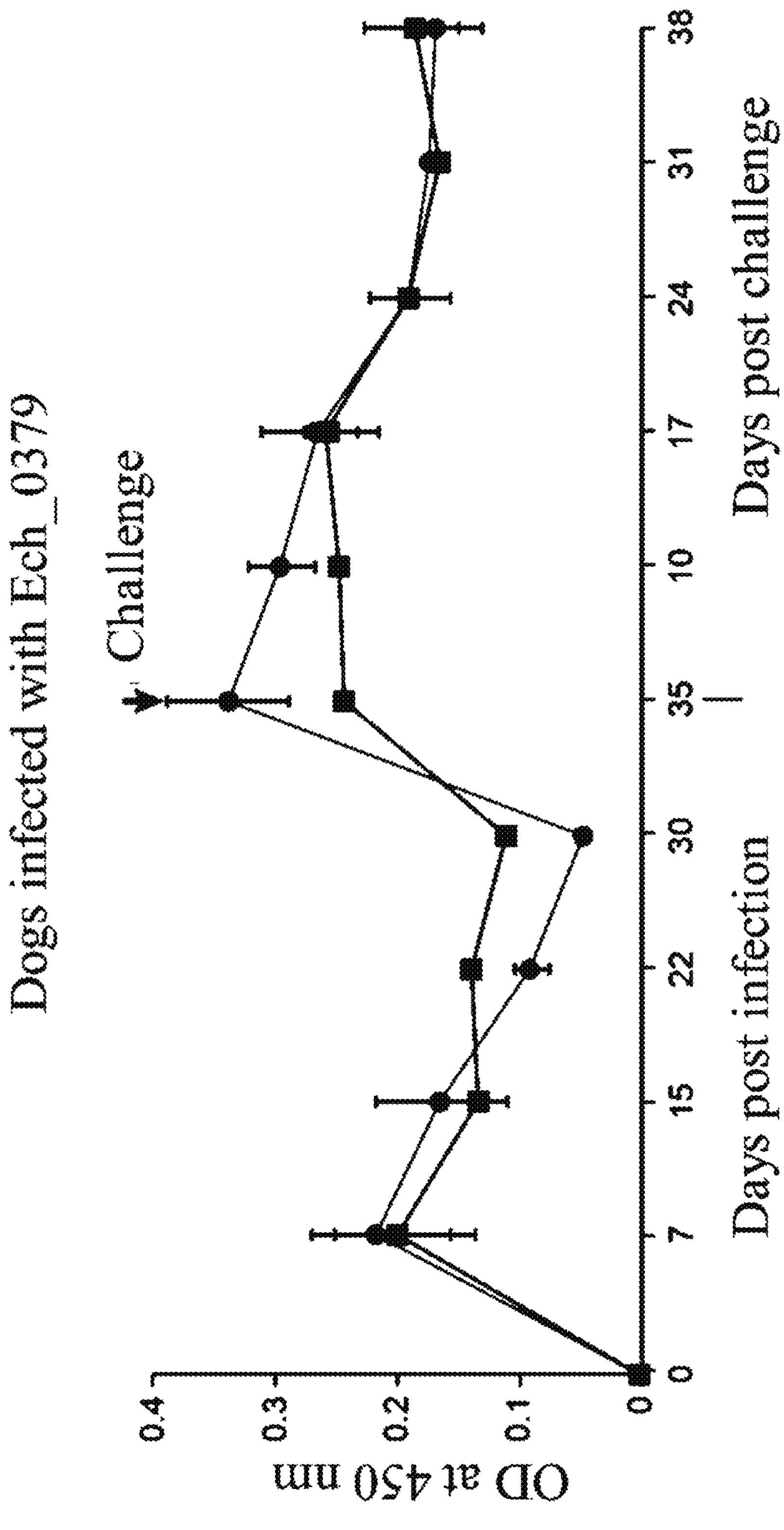
FIG. 9A is data from an ELISA measuring Pathogen-specific total IgG response in dogs following vaccination and subsequent challenge for Ech_0379.
Figure 9B:
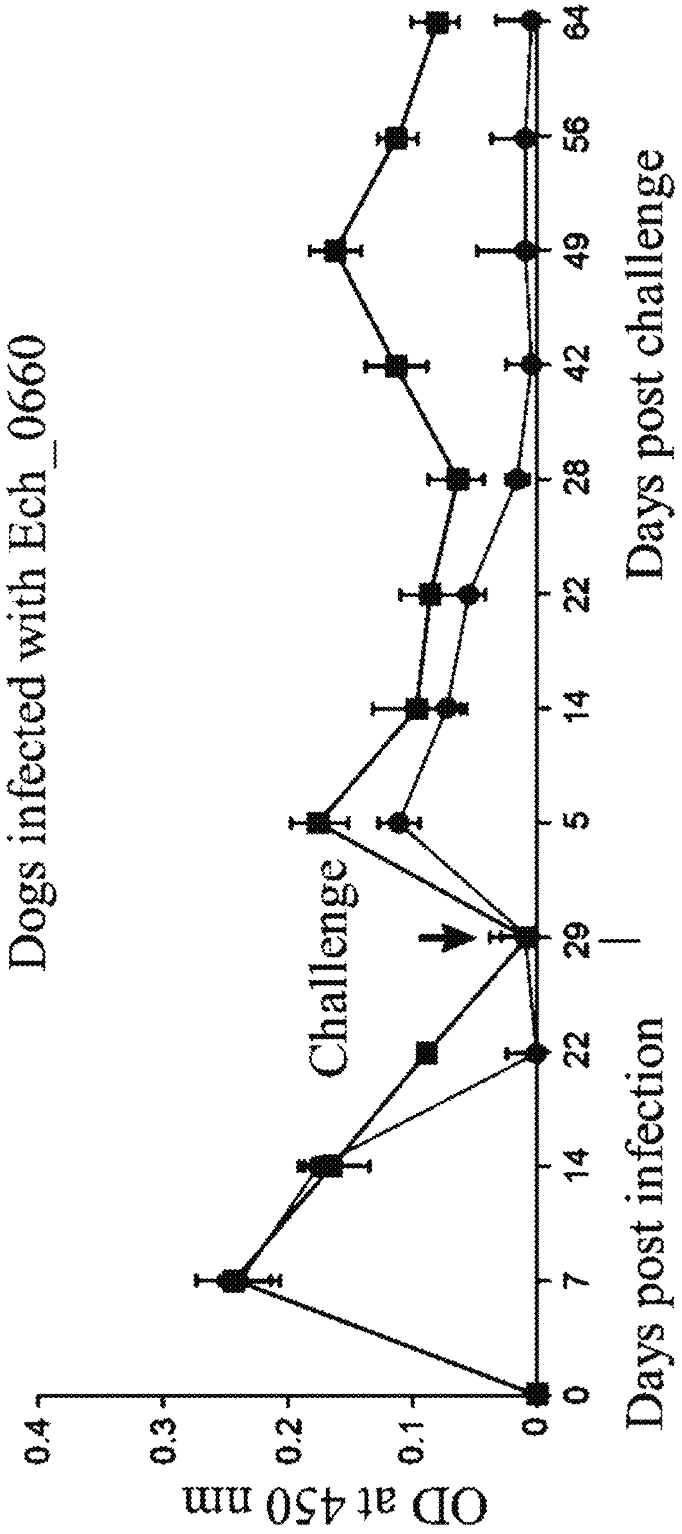
FIG. 9B is data from an ELISA measuring Pathogen-specific total IgG response in dogs following vaccination and subsequent challenge for Ech_0660.

The infection was monitored in blood sampled up to 38 days (Ech_0379 mutant group) or 64 days (Ech_0660 mutant group) (Table 8). The Ech_0660 mutant group tested negative all days after infection challenge, except for the first week in one dog, while the Ech_0379 mutant group challenged dogs tested positive more frequently for the first 17 days post-challenge. DNA recovered from spleen and liver samples from the challenged group dogs at the end point of the study for both the groups tested negative for the organism, while dogs received only wild type infection tested positive (not shown). FIGS. 9A-9B illustrate *E. chaffeensis*-specific IgG response in dogs with Ech_0379 (FIG. 9A) or Ech_0660 (FIG. 9B) mutant followed by challenge with wild-type *E. chaffeensis*. IgG levels assessed in animals receiving mutant inoculated and challenged with wild-type for several days post infection. The data were plotted as in FIG. 3. The day of challenge is identified with down arrows; dogs in both groups had a rise and fall in pathogen-specific IgG responses following mutant infections; and the responses were boosted initially with wild type infection challenges and then declined with time.

To determine if the Ech_0660 mutant is protective in a physiologic setting of tick-transmitted challenge, we vaccinated dogs with the mutant and then performed secondary challenges on day 31-post infection. Four control dogs remained unvaccinated. Seven dogs were vaccinated i.v. with the Ech_0660 mutant organisms. Animals were monitored for the presence of *Ehrlichia* in the blood following Ech_0660 vaccination by PCR and culture recovery methods (Table 9).

TABLE 9

Infection status of dogs vaccinated with attenuated mutant Ech_0660

| | Days Post Vaccination | | | | | | | |
|---|---|---|---|---|---|---|---|---|
| | 0 | 3 | 8 | 11 | 14 | 21 | 28 | 31 |
| Ech_0660_1[a] | – | – | – | – | – | – | – | – |
| Ech_0660_2 | – | – | – | – | – | – | – | – |
| Ech_0660_3 | – | c[b] | – | – | – | – | – | – |
| Ech_0660_4 | – | – | – | – | – | – | – | – |
| Ech_0660_5 | – | – | – | – | – | – | – | – |
| Ech_0660_6 | – | c | – | – | – | – | – | – |
| Ech_0660_7 | – | c | – | – | – | – | – | – |

[a]Seven dogs were inoculated i.v. with $2 \times 10^8$ *E. chaffeensis* mutant Ech_0660 organisms.
[b]Dogs were tested at the indicated time points for *E. chaffeensis* organisms in the blood by PCR (p) and culture recovery methods (c) as previously described.

We have shown previously that the Ech_0660 mutant is highly attenuated and rapidly cleared from the canine host. In agreement with our prior studies, the Ech_0660 mutant was detected in only three animals on day 3 post vaccination. Thirty-one days after vaccination, dogs were divided into groups. Two Ech_0660 vaccinated dogs were challenged with wild-type *E. chaffeensis* via needle inoculation (group 1). Three vaccinated dogs were challenged with wild-type *E. chaffeensis* by tick transmission (group 2). The four unvaccinated control dogs were challenged via tick transmission with wild-type *E. chaffeensis* (n=2) or a wild-type like, isogenic mutant strain Ech_0480 (n=2) (group 3). We have previously demonstrated that the Ech_0480 mutant behaves like the wild-type strain of *E. chaffeensis*, displaying similar persistence in the vertebrate host; therefore we have combined the data for these two control groups (group 3).

*E. chaffeensis* infection in dogs varies from subclinical infection to severe systemic disease. Mild clinical signs may manifest as low-grade fever or thrombocytopenia, as others and we have previously reported. In this experiment, we did not observe significant clinical disease in vaccinated or control dogs (data not shown). *E. chaffeensis* infection was monitored in the blood after secondary challenge using nested PCR and culture recovery methods. The results are shown in Table 10. Dogs that were vaccinated and challenged with wild-type *E. chaffeensis* by needle inoculation (group 1) were protected from infection, as evidenced by testing positive for infection in the blood only twice in one animal on days 8 and 11 post challenge (12.5% of the time), and testing negative for the organism in the spleen and liver at the time of necropsy. Vaccinated dogs that were challenged via tick-transmission (group 2) were also protected from secondary challenge. This group tested positive for *Ehrlichia* in the blood 29.1% of the time (7 out of 24 total blood samples tested). However, no blood positives were obtained after day 15 post challenge, and all animals were also negative for the organism in the spleen and liver at the time of necropsy. This result suggests that while dogs may develop ehrlichemia early following infection, vaccination with the Ech_0660 mutant promotes protection from long-term pathogen persistence in the blood and organs. In contrast, unvaccinated control dogs (group 3) displayed persistent infection, testing frequently positive for the organism throughout the 31 days of assessment (about 34.3% of the time: 11 out of 32 samples tested) and moreover testing positive for the organism in the tissues at necropsy.

TABLE 10

Infection status of Ech_0660 vaccinated dogs and unvaccinated control dog following wild type *E. chaffeensis* challenge

| | Days Post Challenge: WT *E. chaffeensis* by needle transmission | | | | | | | | Necropsy[e] | | |
|---|---|---|---|---|---|---|---|---|---|---|---|
| Group 1[a] | 0 | 4 | 8 | 11 | 15 | 22 | 29 | 36 | blood | sp | liv |
| Ech_0660_1 | – | – | – | – | – | – | – | – | – | – | – |
| Ech_0660_2 | – | – | p[d] | c | – | – | – | – | – | – | – |

TABLE 10-continued

Infection status of Ech_0660 vaccinated dogs and unvaccinated control dog following wild type *E. chaffeensis* challenge

| Group 2[b] | Days Post Challenge: WT *E. chaffeensis* by tick transmission 0 | 4 | 8 | 11 | 15 | 22 | 29 | 36 | blood | sp | liv |
|---|---|---|---|---|---|---|---|---|---|---|---|
| Ech_0660_3 | – | – | c | – | c | – | – | – | – | – | – |
| Ech_0660_4 | – | – | c | – | c | – | – | – | – | – | – |
| Ech_0660_5 | – | – | p/c | p | c | – | – | – | – | – | – |

| Group 3[c] | Days Post Infection (non-vaccinated control group): WT *E. chaffeensis* or Ech_0480 by tick transmission 0 | 3 | 7 | 10 | 14 | 17 | 24 | 31 | blood | sp | liv |
|---|---|---|---|---|---|---|---|---|---|---|---|
| Wild-type_1 | – | – | p | – | c | – | – | p | – | – | + |
| Wild-type_2 | – | – | p | – | c | p | – | – | – | – | – |
| Ech_0480_1 | – | – | – | – | c | – | – | – | – | – | + |
| Ech_0480_2 | – | p | – | – | c | – | p | p | – | + | – |

[a]Dogs from Table 9 were challenged 31 days after vaccination. Animals were challenged via i.v. inoculation with 2 × $10^8$ wild type *E. chaffeensis* organisms;
[b]Dogs from Table 9 were challenged 31 days after vaccination. Animals were challenged via tick-transmission with wild type *E. chaffeensis* organisms;
[c]Unvaccinated control dogs were challenged with 2 × $10^8$ wild type *E. chaffeensis* organisms or 2 × $10^8$ Ech_0480 mutant *E. chaffeensis* organisms;
[d]Dogs were tested at the indicated time points for *E. chaffeensis* organisms in the blood by PCR (p) and culture recovery methods (c) as described. Animals testing positive by both methods are indicated by (p/c);
[e]Animals were euthanized and necropsied on day 39 post challenge.

To determine if Ech_0660 mutant inoculation protects dogs against a heterologous challenge, we challenged the remaining two Ech_0660 vaccinated animals with a closely related *Ehrlichia* organism, *E. canis*, by needle inoculation (group 4). One unvaccinated control animal was also infected with wild-type *E. canis* by needle inoculation. Dogs in group 4 tested positive for infection in the blood 81.2% of the time (13 out of 16 samples tested), similar to the unvaccinated control animal (Table 11). Importantly, as only two animals were included in this group, additional experiments will be necessary to confirm this result and to achieve statistical significance.

TABLE 11

Infection status of Ech_0660 vaccinated dogs and unvaccinated control dog following wild-type *E. canis* challenge

| | Days Post Challenge: WT *E. canis* by needle transmission | | | | | | | | Necropsy[d] | | |
|---|---|---|---|---|---|---|---|---|---|---|---|
| Group 4[a] | 0 | 4 | 8 | 11 | 15 | 22 | 29 | 36 | blood | sp | liv |
| Ech_0660_6 | – | – | p/c[c] | p/c | p/c | p/c | p/c | p/c | p/c | – | + |
| Ech_0660_7 | – | – | p/c | – | p/c | p/c | p/c | p/c | p/c | – | – |

TABLE 11-continued

Infection status of Ech_0660 vaccinated dogs and unvaccinated control dog following wild-type *E. canis* challenge

| Control[b] | Days Post Challenge: WT *E. canis* by needle transmission 0 | 3 | 7 | 10 | 14 | 17 | 24 | 31 | blood | sp | liv |
|---|---|---|---|---|---|---|---|---|---|---|---|
| E_canis_1 | – | p/c | p/c | p/c | p/c | p/c | p/c | p/c | p/c | + | + |

[a]Dogs from Table 9 were challenged 31 days after vaccination. Animals were challenged i.v. with 2 × $10^8$ wild-type *E. canis* organisms;
[b]Unvaccinated control dog was challenged with ~2 × $10^8$ wild-type *E. canis* organisms;
[c]Dogs were tested at the indicated time points for *E. canis* organisms in the blood by PCR (p) and culture recovery methods (c). Animals testing positive by both methods are indicated by (p/c);
[d]Animals were euthanized and necropsied on day 39 post challenge.

A subsequent analysis of the *E. chaffeensis*-specific IgG response of vaccinated vs unvaccinated animals followed by challenge with wild type organisms was performed. Vaccination revealed a pathogen-specific IgG response in 4 of 5 animals (FIG. 10). Both vaccinated and unvaccinated animals exhibited pathogen-specific IgG responses following challenge.

Figure 10A:
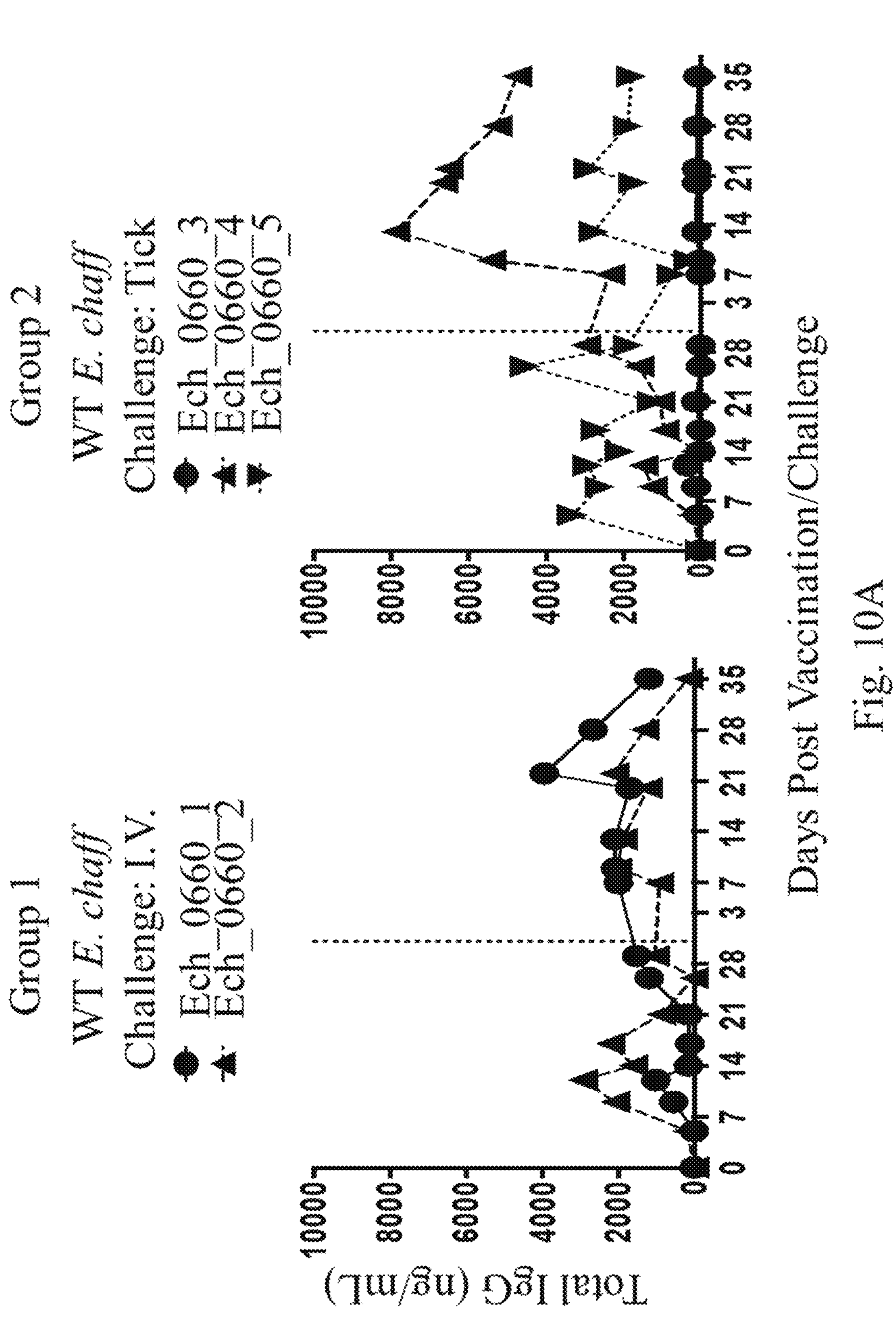
FIG. 10A is data from an ELISA measuring Pathogen-specific total IgG response in deer following vaccination and subsequent challenge delivered by injection vs tick for Ech_0660.
Figure 10B:
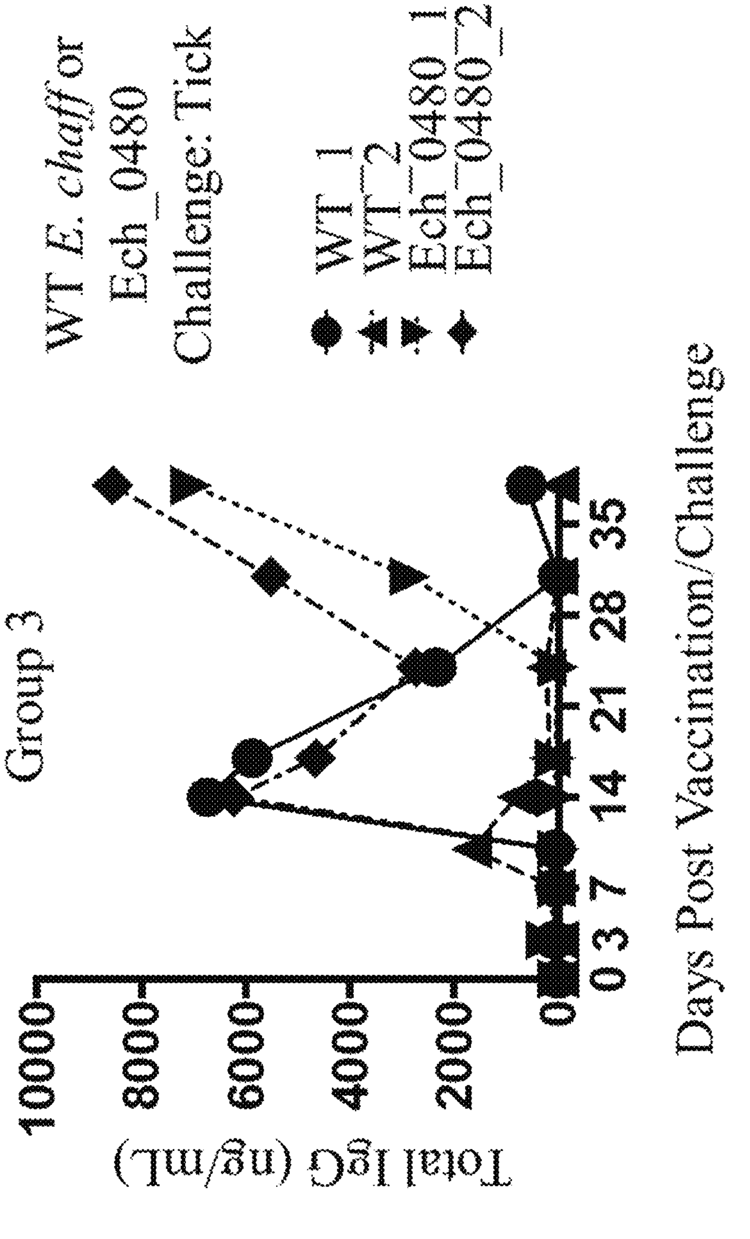
FIG. 10B is data from an ELISA measuring Pathogen-specific total IgG response in deer following vaccination and subsequent challenge delivered by injection vs tick for Ech_0480.

FIG. 10A illustrates total *E. chaffeensis*-specific IgG measured in the plasma at multiple time points by ELISA in dogs vaccinated with the Ech_0660 mutant and challenged with wild type *E. chaffeensis* via needle inoculation (group 1) or vaccinated with Ech_0660 and challenged with wild type *E. chaffeensis* via tick-transmission (group 2). FIG. 10B illustrates unvaccinated control dogs infected with wild type *E. chaffeensis* or the non-attenuated Ech_0480 mutant via tick-transmission (group 3). Each line is representative of a single animal.

SEQUENCE LISTING (36 sequences)

SEQ ID NO: 1 - DNA, 1176248 bp, Ehrlichia chaffeensis
aatgacaaaaagactaggaaaaggcatttttgagttaatagggaatagcacattagaaattaacaacaacatcagtactgatacccaccttacaatgccgataaatttattaaaccctagtacatcacaaccaagaaaaacttttaatcaagaatgtcttaaggaactggcagaatctatttccaaacacggcataatacaaccaataatcatcagaaaaaatccacataaaaaaggatatgaaataatagcaggagaaagaagatggagagctagcatactagcaaaattaaaatcagtacctgtaattgtaaaagaaataagtgatagtcagtgtttagaattatcaatcatagaaaacatacaaagacaagatctaacacctatagaggaagctgaagcatactctaacctcatcaatactttttcttatacacatgaagatttagcttccattataggtaaaagccgtagtcatatcacaaatatgataagaatattatctttaccaacttctataaagtctatgataaacgataaacttatatcatttggacatgccagagctttaataaatattgaaaatccagaagcaatagcagaaaaaattatttctttaaatttaaacgtaagacaaactgaactattaattaaaaatttacaaaaaccacataagaaaaaatccaaagaaaacttaacagaactagagcaatcactatctgaaatattaaatttacaaattaaaataaacggtttaaaaaacaaaggcagtattgtgataaaatataacaatacacaacaacttaactcaatactagagaagctcaagaaagtaactcaaacatagactttcaatataacaccaaagatatgtaactttcgaatacaattactgttttttttttacgcaaaagtaattcttaaaaatcactatatataaaattgtaattgagctaattatacatagcatatattataatataaattatggtttacgtatattaatggaaaatgatttaatatgcctcggtgtgattacatcatctcacgggattagcggacatgtaaaaataaaaacttttacagaaaacccagaagattttacatcttacggaacattaactgatgggataaacacgtacgaagtagaaataatatctatcatatcacaaaacataataattgcacaaattaaaggcatagtgtcaagaaccgatgcagatttactaagaaacaaaaagttttttgtagagaaaaacaaattacctaaccctacaaatgatgatgaattctattatagcgatttaatagggctaaacgttgttttagaaaacaataatgtttatggaaacataaagaaaatccacaattttggatcatgtgatattatagaaatacgtctttctaattcaaaaaaaagcactatgttaccttttacaaaagatatattcccctatgtcaatgtcaaagaaaaatacataataataacattgccagaagttataggaaataacagtgacattcaacgttaacgttttaaccatatttccagaaatgtttccaggaacattaagccattcaataataggtagagccctaaataaaggcctttggaaccttaatgttatcgatataagatcatttgcaaaagataaacataaaactgtagatgacaggccttacggcggtggacctggaatgataatgaaagcagatgttataggctcagcaatagatgaagtattaagtaaaaacaaaaacacaaaactaatatacatgtcccccagtggaataaaattaaatcaagatatttctggacaattaacacatttttctaatataactatactatgtggtcgctttgaaggaatagataagagaattttagatttttatgattttcatgaaataagtattggagattatatattatctggtggagaagttgcttgtatggttctcatagagacttgtgtcaggcttatacctggggtagttagtaatacacaaagtatacgtgatgaaagttttaccttagactataagttagaataccctcagtacacacgtccagcaaaatggaggggattagaggtccctgatgttttactctctggaaatcataaaaagattaacctttggaaagccaatcaatcttactgtataaccaagcaaaggcgtcctgaattgactggtaccatagatggagatatatatgagtgatttgcttaaggagttcaatgaacaacaaatgaaattgttgtccaacaaagaaataccaaagtttagttcaggtgatacactaagagtaagcatgaaaatttttgatggagtaagcgaacgtttacaggtattcgagggagtatgtatcaaaagaaaaaataacgggttacactcttcattcactttaagaaaaataagttacaatgaaagtattcaattacaggtgtttttatactctcccatagtagagtctatagaggttattaaattcggtagagtacgtagagcaaagctttattatatgctcagtctatttggtaaatctgcaagaataaaagaacgtagtgataggacaaaaaagctatcctaattacaatttcatacagtatatctcaattttgtaattattatttatcacacattgaaaatttacatgtaggtgctgtttattacaagttttaaggttttacctatttgaagcttttcagttagttttctctaattgcttgtacctttaaaagggctgaacacataaattcctttcatagtaaagagtaattagtagcatatatgctaaaagtactaccacttactgtgtagttagtatttagattttggctataaaactttacttcattttatgtaacaggaaatccatagctgcacttgctgatgacatttgtactttacatctattcatatcactaaagtaatattttttacaatctctttctatatttgaagcataacctatataaaccaaacctacttgctcatcaccaactctaggaccagcaaacccagtgattgagacagacacattagcctttgaattttctaaaacaccaactgccatcaaaacagatacttctgaactcacagctccatatttactaataagatctttatcaatatttaaaaatttagccttagattcatctgaatacactacaaaactagaatctaacacttttgatgcacctgggatacaagagaatagaaaagacattaatcctgctgtacatgattcagctattactattttagaattgttttctattagtttcgagacacaagtttcagctttttttaatatttcttgttctattatcatgtaataacactatcaaattataaataaattcatataatcactacaaagcaaatcatacaataaaatttagcaacaaaataacaaaacataaatatattaagtcaaaaaatccatatactattaataatagaagtaatatcttataaatgtttactaactttacttacaacaaaaaacacagttattaagttataaaaagtgtagctcctcaaattctccatacaaaattatttaagaatagcaattgagttaaaaaatacaatgtaacacactcaaaattaagatataatagcaaaataaagttgtgactttaaagattaaatagtaacttatggttaatataatatgataaacatccactttagtaacaatttatgcaagcagtttcatcgtggaattaaaggacatgatatagtaaatgacctatttccaaaattaaaaaacgaaacaatagctgcaaaagtaaacggagaattatacgatttatcaagagaaatcatagaaaattgcacttttgaagtcataacgataaacagcgaagaaggtcttgaaattatacgtcatgatactgctcacatcatggcacaagccgtgaaagaaatgtttccagatgttcaaataactattggaccaactattaaagacggtttttattatgatttcgcaacaaatcataacttttctagtgatgacctagaaataatagaaaagaaaatgatagaaattataaataaaaatgaaagctttatacgggaagtatggtctagagaagaagctataaaattcttctcaagtataggagaagactataaggtcaaaataatatctaatattccaagtaatgagaatattactgtttataagcagggaagttttactgatttatgtcgtggaccacatgcaccttcaacaaaaacatcaagagcatttaaattaacaaaagtatctggatcttattggcaaggcaattcaaataatgaaagattacaaagaatttatggtacagcatggcgtaatgaagaagaattaaaactttacttaaataatttaatagaagcagaaaaaagagatcacagaaaaattggtagggaattagagttgtttcatattcaaaatgaagcatgcggtcaaatattttggcacacaaaagggtggactatttatcgtattatagaaaattatatacgaaaaaaactagaaaataatggatatatagaagtaaaaacccccatattgttaaacaaagaactttgggaaaaatcaggacattgggataagtttcgtgaaaacatgtttttaagtgaagcagaagataaaactttagccataaaaccaatgaattgcccatgccacatacagatctttaactcaaaaattagaagttatcgagatttaccaatacgaatggcagaatttggaacatgtcataggtatgaagcatcaggagcattacatgggttaatgagagttcgcggttttactcaagatgatgctcacattttctgtacagaaagccaaattacatctgaagctctaaagttttgtaatttactcatagaaatctacaaagattttggtttcaccgatattctagtaaaattttcagatcgtccaaagaacagagctggtagcgatgaaatatgggataaagctgaagcagcattaaagaaatcagtcgaagttgctaacttaagttatgttttaaaccctggagatggagcattctatggaccaaaattagaatttacattaaaagatgctattggcagagaatggcaatgtggaactctacaaatggatttcgtattacctgaaaggttaggtgcctactatataggtagtgatgggaaaaaacatcatccagtaatgctacaccgtgctatcttaggtacttttgaaaggttcataggaatattaattgaacatcattcaggcaaatttccaatgtggttagctcctatacaattatcaatattaactatcagtgaagattccattaactatgctaattccttgaaaataaaagccgaagaacataatataagagttgaactagatactacaaacgaaaaaataaattataagatacggaaccatatccacaagaaagtacctgtgttctggatagtaggtaaaaaagaagttgaagaaaattctgtatctatacgttatttagagtccaataagcagcacgttatgcctattgataaagcgttgaaaacattattaacttgtgctagcatctagtaaattttagtcaggagtgtaagattgaaaacaaaaaagttctctaataaaaacaagattaatgaaatgatcacagcaaaaaaagtaaagcttgttgatcaaaatagtgttatgattggagttgtagacattgaagaagccttatctagagctaaagctgtcaatttagacttagttgaaatagtacatgatgatcaatatcctttatgtaagatatttgactacagtaaatataggtacagccataagaagaaaataagcgattcaaaaaagaaacaaaaaaccatcatagtaaaagaacttaagtttaagcttaatattggagataatgactataacgtaaaattgaacatgttacgtggatttatagaaagaggtgataaagtaaaaatatcgctaagatttataggaagggaaatacttcatccagaagtcggaatggagattatagaaaggttaataagagacaccgctgatattgcaaaacctgaaaatttaccaaaaaaggaaggtaatataattaacatggtattaactgcaaaataaaatttttatataactccagagcattatagcatttttaagttgtaatgctctaacttccaagaattggtttgattattaacaatactcacagtgaagtgaagacattctaattcaagcagcgtataatagaatacaaaacatactataaactttaatcgacacaacataccaggaaaaattactatcaattatatcatggctacaataagaattaaaaaattgtaaatataaaactagttgacaatatatcaatgttattgctctggagcacagggcattattacctttaattactgcttacaaaactttcaaaaataccacatttatcatcatctttaataaaaacttcaacatctctaagattttctttcgtagaatactttatatttatttttaggttaaaatccaatatgtcatttaataagtcaggccactctataattcccactccatcatcacaaatggattctattcctaaatcatacacctcacgcaaggaattaattctatacaaatcaatgtgatatatcgtaaatttattagaatgatattcattaataatactaaaagtaggactacccacatcttcacatggagctaatgcatgaactaaaaacctaacaaaagtagttttgccaacacctaaatccccaactaaagatatactgtcgccttttttcaaacctaaagcaataaaacgtgccaatttctccaaaaatactaaatctacagaactatatttaaattgcaacacattcttcttgaaaaaaaaattacttacgttcgccttgcaaatttagcaagcttataaatatattaatgtaattaaaatataaagtagttgcacccagtatagccatcttattcacagaagaatcagtgccatcattaaacttataatacatatccttaattctttgagcatcatacgcagtcataccagtaaatacaaccaccgcaacaactgacaaggcaaaatgtaatggtccactacctaaaaacaaattaaccagtgaagctatagctatccctataacacccataaataagaaagtcccaaactgagacaaatcctttttagtaacattaccataccatgccattacaccaaacatggaagatgaaataaagaacacttttgcaatactcgctgccgtatatactagaaacacataagaaatagataccccaactaatgccgcaaagctaaagaatatcatcaatatggcttgaaagcttaaaacattcagcttatacgacattagaaaaactaatcccataggtgcaaaaacaatcacccagtgtaaaggagtattatataccatagaaataacagcaggagaagaagccacaaaaaatgctactataccagtcaaacctaaagccatagccatgtaattatatacttttactagataattcctcagtccagcgctatagtaagcaccttgctgtacattactgtaattatccataaatactccacttcagaaaaaaccactgaattatagcaaaaaaatataaaaatatcaatacaaatttatcatgaatcttgtaaaagatgtcttgtctcacaacaaatttgctcaacatcctgcatattggagttaacgctagcacctttaggtagtccattacgtacttcattagataatttatcatgttgttgtgtactcatatatagcatcagtccatacccaaaacaaaatattgccataccaacagcacgaactattaatgccattggaaacgcatccataccaagaggaccaagaactcctgtatacattgcaccacctctagtctcaaaagaaagcaacactttcccagctaaaattaaaaaagtaccaaaaaatagactagtaagaactaatgattgagcaacactgtatgtagacttaccatctttattcttatttttattacatttaatcatgtaagaacataaaaacatacctgcagctattgtgaaaagtatattccctacagtatctacaattccctgcaagttaaacgcagtatcaacaggaattttactgacatcaaaaattgctggaagtgtcaaactaaaaacagcaatcgcttgcataatagtagtacaaaatgtacctgcaagatcaaacttattcgcatgcgtctcacaaaagtttgcaaatttaatactagtaggatttacacgttcatcaaattgatcttgactgattcttttcaatttttcatttacttttcttttttccctttctaaatatagaacattgtataaacctgctataagaaaagttacacacaaaaacaaggctaaataatccataaaattagcaaaaagtgttaactgattttgcgttaaatccagaacccctgattgcatgacagcaaatgaaacaaaaactacaaagtaaagaacacttgtaaccataactattttctttctaatcagatcttgacgatccaacttcaataacatactattgtatagtttcctttgtatatcacctcgactaatgccttcatattgttcaagttgtcttctatcttcaccaaacattctaccctccacgctcacaacaagtacacacttacttttagaatcaaatgatagttctacagttatattatatcataactataaaaaaaaacaaaaccattaacttgtttactctctgataatataaatattttttaatatactaaaaaaggtataaaaatgcaaaacattattattaattattttatataaaaaaagaaaaaatatgaaaataggaataaatggattaggtcgtattggaagatgcttaataagagccatatacgaaaatgaattattatataaacacaaaatagaattatctgcattaaatggatctacatcaccagaaacacatgcacatcttattcaatatgattctgttcatggaaaatttccacataatgtaacatcagaagaaggatatataataataaatgataaaaaaatcccattatcaacagaaaaagaacctaaaagcattccttgggaaaaacataacgtagatatcgtactagaatgtacaggaaaatttaataaaaaatctttagcagaacaacatataaactctacagtaaaaaaagttttagtatcagcacccatgcaagattctgatgcaacaatcgtatatggtgtaaataatgaaatgctaaaaaaagagcacaatattatctcagctggatcatgcacaacaaactgcatagcacctattttaaaaatcatgaatgatactataggaatcaataatggatttatgacaactatacactcatacacaaatgaccaaaacttagttgataacaatcacaaagatgtaagaagggcaagagcatgcatgatgtctataattcctactacaacaggagcaacaaaaactattgatttaataataccagaattaaaaggaaaacttaatggaaccgctgtacgtgtacctacagcaaacgtatccatggtagacttagtttttaattccattaaatcaactactgctaatgaaataaacgacataataaaaaattcttcacaaaactccaaagtaataaacataacagataagaaattagtatctatagacttctgtcacagtacatatagttcaatagtagatgctgatgaaacatatgttaccaataataatctgtgtcgtatagcagcttggtatgacaatgagtgggcttttgctatgagaatgttagatatagtattactattatcagaaaatcatatttaaaaaatgtaggtaaggattgtattacttaagaaattaagattataactatctttacctataaaatacctggccacgaaaacacatttataagtacaaagcaaagcttaataacacctataacctgttataaaggtatgcaacaaaaaacatagacatatattgctcaactactaaatacttttaaatgacaagtacagaattcttacccactgtaacaatactatacactttaagtataataaatttggtattataaaaaaaaataagttttatagttacttactttttagataatttaccatggatgatatcatgtcttgtatcccaagatatacattataaaggctatcattcctcatatacgcagaacaagaaaatattctgtttacatcatccttaacagatttaatagtaggacaatcaacatgaactcctcccattttatctattaaaccattagagtcttctcctattgtcaccttaacctttgcaatatcttttaataatgcaactactactgcaggtgatatacaaactgcccctataggttttttagcattataaaactcacgcacagcatttttaaattcaggtagtatataatcattttccttatcttcatcaaataagttagaaaaattttttgctactccatagccaccaggaattactaacatatcaaactcttctactctaatttgttctatatcatatacagaacctctagctattcttgcagattcaaccaaaatgtttcttacttctcctaccgattccttctttttatgatctacaacttgtttttgatttttatttggtgcaaaacatttaaaatttacattatgcctatcaagttcaagcataactaaaacagcctctctgatctctgaaccatccatatgaccacaaccagctaaaataacagcagaatttaatgccataattaaatacccttttctggaataaatgctaattttataaaaactatttataatttacaaatttatttgagtattataatattacacaattgtatttattatcgtttacctaataaacaatgaacatattactaataggatgcggtaacttaggaagtatattattaaataaatggtcacatagtgatcaaatatcaaaagtgactgtagtacagcctagcttatcaaaaaaggatacttttaacaatataactaaggtagtctttgtaaaaagtcatgaggaagtagataaagattttatacctcaaattgtagtaattgcaataaaaccacaactggtgtctgatgttatgccaaactacagaatttatagtgaatctgcatcttttatatctttatgtgccggaattgatattaattttctaaaaacatgcttaagtcctacagcaacaataattagggtaatgcctaatattgccatgtcactaggcaaaagtgtaaacctttcttatatagaagaagaattaccacatgaaaaacaaaaagtatcaactatttttaataacacaggacttatatattggatacaaaaagaagatatctttgacaaattatctcctattactggttctggtcctgcatactttttttctcttgcagaagaattagtaaaaaatactatagctgcaggtatcaatgaagaagatgctattaaacttgtatctcaaacatttataggaagtgctaaattgctagaaacaagacaaaatactataagtcatcttatatcatctataacaagccgcggcggaataacacaagctgcactgcaggtgttaaatttacatttacctcaaacaattagttcatgtttaaaggcagccatggaaaggctattatacttaaaaggattagataaaaataaataataagtgttacgcaacacttattagtagttatttttagaaaaaataaactaaaaattttatttgatatttctttaagttaaattataatgcaaagggtaatatgagcaaagggcttgtgaagccggtcaggttaggaataaagcagccgtagcattgtttctttgggttgtattgcccattttttatgttaccattctacaatgagttttgcattaaagtatagacctagtaattttaaagatctcatagggcaagaggttttagttcgtgttctacataatgcatttcacttaaataaaataccagaatctatacttttgacaggtattagtggtgtaggaaaaactaccgctgcaaggataatatctatgtgcttaaactgtatttctggaccaacgtctgatccatgtaatacatgtcaaaattgtatatctataaaaaatttcaaccatccagatgtaatagaaatagacgcagcaagcaacacaagcatagaagatgttaaagtgattttagagaattcgcgctacatgccaattagttcaaaattcaaagtatacataatagacgaagtacatatgttatctaatagtgcatttaatgccctactgaaagtactagaagaacctgcaccttatgtaaaattcattttagcaacaacagaagtaaaaaaaatacctgtaactattatatctagatgtcagaggtttgactttcaaaggatatccacagataaacttgtagatcatctaaaagtcgtggcaaaaaaagaaaatgtatccttcgatgaagaaagtataaaattaatagcatataatgctgatggatctatacgcaatgctctatctttattggagcaagctgctatatacagtaataaaatcttatctgaaaacatcacaaaagaaatgctgggttatgttagtagacatacattactagaaataatagaaccattaattatagggaatgctacagaagctctaaataaatttgaagaagcatgtaactcgtataactctgttataattttagataatatgttgcagattatttatgaaatatgttacttctctataacaaaaaaagacaactctacatctgataacagtattataacatatataaaaaacgaaaagattttatctcctacatttctatcaaggttatggcaaatgctttttaaaggtatacaggaagtaaagtcatctagctgtataaagcaggctgcaaatatgctaatcataaggttatgttatttgtcatctttaccatctccaaaacaaataatagataagattcaaggaaaaataaacaacacatcagatattaaccgtaaagcattacttgaattgttaaaaagtaataacatgcaagacttatataaccaaatttacgaatctgagtcagaagtaaaaaattataaagatgaagcattaaatatagaaactaaccaggcattatctaaagattttcatgaggattcactaaattttttcaataattcaacaaataaaaaatgtaatgtacccattgaacaaaattttgatataaataaaagtagtaatccatgttataatcaacatcttgatccaactgtttgcaatatattacaagagttcgatggagcaaaagttataaatatagaaaacataaaaaagaacaacaataaggagtgagctatgtactctagcgatcaattatctaacttacaagagatgataaaaaagaagttttccgactttcaagaacaccaaaaatctcaaatatttgaaggttcatcacttggtggaaaagtgtctgtaaaaattagtgtatccaatatggtaagctatcaagttgttgaagtaaaattagacccatcacttctacaagaaaaagccattttaatagaagatttaattaaagcagcactgaacgatgctttaaaaaagtcatccgattacaataaaaatcttgtaggttctttattatcatttggcatataatagaaaagacatgagttataaaatagcagtagtaggtgccacaggaaatgtaggtagggttattctgaacattctggcaagcaggtcatttccagcaaaagaggttgtagcgctagcatcaaaaaagtctataggtaaaaaattaagttatggagatgaagtattagaatcccaagacttagacagttacaactttactaatacagacatagcaattttttcagctggatcttcaatatcacaacagtacgcacgaacagcagcaaataaaggatgtataattatcgacaatacttccttatttcgtatggaagatgaaataccattagtagttccagaaatcaatccagaagacatagctcaatattataaacataacattattgccaatccaaattgctctactatacaaatgcttttagctttaaatccattacataaaatatcgaaaataaagagagttgtagtatcaacgtatcaatcagtttctggtgcaggaaaatctgcaatggatgaactctattcacaaaccaagggcacgtttatgaaccaaaacattgcccctaaacaatttacaaaaagaattgcttttaactgcattccacacatagatgtttttatggaagatggttcaacaaaagaagaatggaaaatggccgtagaaacaaagaaaatattagataataatatagaagtaagtgcaacatgtgttagggttccagtatttgtatcacattctgaatcattaaacgttgaattcttatctgagatttcagaagaagaagcttatgaagcattagaaaatgctccaggagttataatccttgataggagagaagatggtggatacgcaacaccattagacagtgtacatgaagacgaagtttatgtatcaagattaagaaaagacaacacagtaaaacatggtcttaatatgtggttagtaagtgacaatttaagaaaaggtgcagcattaaatgcagtacaaatagcagaaatacttgttaatgattacctttaaaaagatatttttaaaatagcaaatattgtaacactatatgaattaccagatttatttcagcaccgcttatttttataatgcacacgagtaattcctttcttcctattaaaaaatggtctaacttgaaaaaatctttttattaacacatcaatatagatgttgaattatgtggataactagagtttactacagcatcatttacattaagacacacaagtaaagccactcttattgcaagtatatcatacaaatgtatgatcaactatttctcttattttatgattaatctataaacatgataacaattcataagcaacttatacgttaaatatgaaattcattttttaattttaaagcaagatcttctctctcccaggagaaacttccattttcatcaggtattcttccaaaatgcccataacatgatgtaatcctataaataggattaagtaatactaagtgtttacaaattccataaggagataaatctatattatcttgtataaaattttttattatatcatcatcaacaaatccagtaccaaaagtattcacataaaatgaaataggataagacacaccaatagcatatgacaactgcactaaacattgatcagccaatttcgcagaaacaacattccttgccaagtaacgagccatataagcagcagatctatctattttacttggatcttttccagaaaaagccccaccaccatgaggtacatgtcctccgtatgtatctatcataatcttacgaccagttaaaccacaatccccaactggaccacctacaacaaacctacctgcaggattaactaaaaagtcactatcagggcacatccacccttcaggcaaagactccttaacataaggataaactatgtctcttatctgactttttgacaaatcttcagaatgctgtatagaaagtacaatattagacgctctaacaggaacattatttttatacaacaatgtaatctgtgtttttgcatctggaccaagatttggtatctcacaatttttcactgcagaaataatattcttcaaaattaaatgagaataaaaaattgatgcaggcataaaagtttcagtttcatttattgcatatccatacactataccctgatcaccagcaccctgcttttcaccagaactaactccaacaacaatatctggagattgctcatgtattaaaatttcaataacaacatatttccaatggaatccatcttgttcatatcctatttcttttataacttgacgagctatacactctatatcaaatttattaatactaactccacaaatttcaccactaattattaccttatttttcgttactaaagtctctatagcggtatgtacaagtggatttaatgatatataatagtcaagtatggcatcagatatttgatcagcaactttatcaggatgtccattggaaacagattcactagttatgatgtggtcagataaacaatttttataataaaacatgttaaaaacgtaaacccaaagactcttatagtatcaaatctgaaataactaaacaatatataaataatatccactttttaatacattaatatctttcatgtcatcacactcgctaataatacattcttcattactaattcaaaaatataaataatatacagaagacaagttcactaatataaaacaacatatctcatcaatttatacccattcttcaaacttacaaaatgtagataatcctaaaaaacctataaacttgacaaatgtgttaattaaagtaccattttatatttacaatgtgcccgtagctcagctggatagagcaccagccttctaagctgtgggtcaggggttcgaatcccttcgggcacaccataaaattgacaatttttaattattaatacacttttttatacttttgcgtatttttgtatcatgaacaatagcaagtactatgacgtagttatctcaggagcagggatcaatggaatgattacagcaatagcattaagtcaactgtctatctctacagctttaatagataaaaacaaaattttactatcaataccaaaagatagagtatttgccttatcaagaagatcccaggaaatattagataagtttaacatatggaacaatataaaagagcattgtcctatattagacatcttaataaaagacgaagatagttcaatatttacacactatgaccataaatctataagcgataatcctatggggtatattgtagaaagcaaatttctatgtgatgcctttaaaaaacatataaaaaaaataaacttgtactcagaatgtacatacaaatcagtaaacattacaaatgatctagtaagaatagaactaacagacaatacaatattattaacatcattattaatatctgctgaaggtaaaaattcaaccctaagacaaatatttgatataccatctatcaatcatgattattctcaaagcagtattatttgtaatataaaacatacaaatcaccataataatctagccatagagcatttttttcatggaggaccatttgcaatattacctatgtatgatggatacaggtcttctgtggtctggacaaataaaacacaaattagtgaaatgcttatgaaactaaaaaaacaagattttatggcagagttagaaaaaaaatgtgcaccttatgtaaacgatataaaactagatagcgaaataaagtgttttccattacatttgatgtttgcaaaacatttatataagaacagatttgcattgataggtgatgcagcacattctatacatcccatagcaggtcaggggttaaatttaggaataagagacattgataaactagtaaaccatataaaatcagcaaagcaatatggtatagatataggtagcaactatgtattaaaaaatttttcctatgacagatactttgataactcatctatggcaattcttactacactcatagatggaatatttactaaaaaatcttgtacagcaaaaattgcaagaagatttggattatttattgttcaaaattcaaaaagcataaaaaattatatgataaaacatgctatgggaataggaaaatttaactaactcttgtcaattacattatcacaatcctcctttttatttttcatgcacaaaatctctacagtcattttattgattgatttttctatctccatcattgcattcctttttattctgtacatttcctcacgataatcagcttgcctaaaatcaatatcagttttatcacgaaattctaaattttctccaccataactattctttttaaacatagaacatatgtattcaaacatacatctaaaaaattcattccaattaatcttagaaatcttcaaataagcccaaaaaggtataactaatgatacacctgctttaaaaaatacagaataagttagcgaatcagagttataataacaccactttaaatacttataaatgtaaatagcaacattcttaggatctctatattcaaaagcaaatctaattccttccttcatcataataaatatgaaagaagaaaaataaagaaacactgcaaaaaacaacagatttattagaagattcttcattttccttaatataaaggaaaataacatgtacctataaaaaaacataaggttattatatgaaattactttttaaaatggctgggatggaagggttcgaacctccgaatgacggtatcaaaaaccgttgccttaccacttggcgacatcccatctataccaaaaacaactatatagtaattagtaaatcttacctcatgattaacaaagattatactgatagcacaaaaatgcaaggaaaaataaaaccattaaaaataaaagcataatatgctactttttagatttaataaatagattttattattataacttttaataagttatatatttaataaaaaaataaaccttgtataacttcatattattcttctataatagcgataattaggattggttatatttttgtgaattttcaaagtataataagaaacttacaaagttattgggaagactatggatgtacaatatttcagccatatacttctgaattaggagcagcaactcttcatccagcaacttcgatgacagctatatcaaaaaagccatcaaaactggcttatgttcaacctgttattaggccatgtgatggaagatacggtgataatccaaatcgtttatatcagcaccatcaatatcaagtattaatcaaaccttctaataccgatttacaatcagattatttaaaaagtttagaaagaataggaatatctatcaaaactcacgacataaaatttatagaagacgattgggaaaatccaagcattggtgcttggggtttaggatgggaagtaacctgtaatggtatggagataactcaatttacttatatgcaacaagtaggtggtattgaatgttctttagttccaggagaaattgcatatggcctggaaaggatagcgatgataattcaaaatgttgacaatatatataaaatattatgggatgataatggaacaacttacggagacgtattcaaacaacgcgaatatgaattttctaaactagctttagattattatgatgtagacattctatttaagcagtttaatgaagctgaacaaacatgtatttctttaatagaaaaaaaactaccattagcagcatatgatgtttgcacgaaagctagtcatatccttaatttgcttgaatctcgtggagtcattggagttaacgaacgtgcgtcttatatattacgcgtacgtaaacttgcaaatttatgttgtagcttatatactcagtgtcattaaaataagtaaaacgacatgcctttagaactattatttgaatgcttatcagaagaaacacctcctgagatgcagagtagtgcatatgcatacatggattcttatataagaaaagaactaagtcgttgtaacatcagttttgagtctgtaaaggtatttgtaacttcaaatagattaaccttgtatgtaaaaaatataatcaataacttatcaaataatacattaaagataaaaggacctaaagtatcagcagataagattgcaatagaaggttttttaaagaaagttaataaaaatttcagtgaccttataacatgcaaaatcggtaatgatgatttttactatgctgagcttaatcataatgaagaaacaaatacagaacatataatcctatcaattatagaaaacatgttaaacaactttccatgggataaaaaaatgagatggggaggtggaaaaacatattgggttcgccctatactaaatataatgtgtatacttgatggaaaagtactaccaataaagtttgcagatatagaagcaaataacaaatcatgtggtaacagattcacaaataaagaattttttgaagttgcagattttaattcttataattcaaaactaaaaaaaaataatgtaattttatgccaaaaagaaaggctcaattttatattacatcaaataaaaagtataacagaagaaagtaatttaatatgtgaggataatcaaaaattaattaataaattgaatggaactttagaatatccaatagttatcatgggatcagtggatgaaaaattctctgagttaccaaaggaattaatactaagtgtgatgcacaatcatcaaaaatacctagctgtttttaaagaagacaaaattacaaactttattacgatatctactatatcaaatgataatataataaaaggacacaataacatattaaatgccaggctattagacgcaagttttttggtaaaaaaagacaaagaatacaatattgattactacatagaaaaactcaaacaaatagtatttcatgcaaaacttggatctgtttttgaaaaagtgaaccgcataatagctttatcaaaatacatttccatatggatacctcattcctcattgataaaggtagaaagagcagcaaaattatccaagtttgatttatcaacactagctataaaagaatttccagaactacaaggaataatgggaggatattatgcctcttactttaatgaatcattagaaatttcagaatctatagttaatcactacgagccaacaaacccacaaaaagaatgtccttcttctcctatatcaatagctgtatccatatctgataaaatagataacttagttggaatgatagttgcaggagagcaagttaccagttcccgtgatcctttttccatgagaagaatggctatatcaattattagaataataatcgaaaacaatttaaacataccaataaggcttttaatagaaaaatctgtatcactgtactcatttgcaattacagaaagaactactattaacaaacttaagaatgtaatatcaagaacaaacagaaaaaaagaaattatttcatctgtaatagaatttttttcaaatagatttaaaattatcctaaaagaagacggcataaaggaagatataataaatgccgtatttgaaagcagaaaattcagtaatttattgttaataaaaacagaagctaagtttcttaacaattatatttttaccaaaaatggggttgaaataataaaggcatataaaagacttagtaatataattacaaagggagaaaacgtaaacaatacagcaaagtacaagtgtaataaaaaattattcacaataaaagaagaaactgatctatataaagaaataacttaccaaaaaaataatataaaaagattgataaaggacaacaagtttgaggaatcgttaaataatctttacaaattgagttgttgcgtaaacagttttatggacaacgtaaaagtaaatgatcaaacaaataaagaattacataaaaacaggctttctattgttaaaaatgcattttatatttttgacttagttacagattttagtaagattaaaaatacacataggtaagtcttgaatttttttaaaatcgtatataaatattttacctgatacttataaagaagaattggtatgagtaagagtgactattatgatctattaggtgtaagtaaaagtgcaacaccagaagaaataaaaaaagcttatagaaaaatggcactaaagtaccatcctgataaaaatcctggcaataaagaagcagaagaaaagtttaaagaattatcagaagcttatgatgttctcatagatcaagataagagagcagcatatgacaaatatggacacaatgcttttgatagctctggaagaggaggatttgattttaatagtggtttttctggtgatttttctgacatatttaatgatctttttggtggaggatttagaggaggaagaggatcatccagaagacatgatagcggagctgtaggatcagatttaagatttgatatagaaataacactagaggattcatttaacggtaagaaagtacctataagttatgttacttacgtaaaatgttcaagttgtagcggttctggaagtgaaggatcagcaaaatccgtacagtgtagtacatgtcatggtgtaggtaatgttagaacacaacaagggttttttacaatagaaagaacatgtcatgtatgtaatggagaaggagaaataatacaaaataaatgtaaaaaatgttctggaagtggtcgtgtaagagatgaagtaaacttacttgttacaattccaaaaggaatagaaagtggtaataaaattaggttaaatggaaaaggagaagcaggatataggggtgcaagaagtggagatttgtatgtttattctaatatacaaaaacataaattctttacacgcaatggatctgacctttattgcaatgtacccataaaaatgacacttgctgcactaggaggacatatagaaatgccatctatagatggaacatggacaaaagtgaaagtcccagaaggatcacaaaacggagataaattaagacttaaagaaaaaggaatgccaattataaattcatcaaaaagaggagatatgtacatacagataactgtagaaactcctgtgaagttaactaaaaagcaaaaagaattattacaaaagtttgatgatgaacctaacgtagattgtaatcctcagtcgactggcttttttcagaaagtaaaaagtttttggaaagatatcaggtcaaactgaaccccaataactgttaatatagagttataatatatgtcaacaaaactacttattattgttgtactctatgtcaagtcctatatctttattttgaaaagagttagttatacacccaatagaaatataatctactcctgttagtgcaatgtttctgacatttcttatgttcacacatccagaaacttctaaaactgattttccattaactatatcaaccgctttttttatttcactaatactcatattatctaacaatatcatatctacattattagacagtgattcctcaacttgagatatattgtcacattcaatagcaatatattcattttttagattttttctaagcctttgtatagctaaggtaatacttccacagctagctatatgattatcttttataagtacaccatcacacaaattgtctctataactttccccaccaccaatacatacagaatatttatctaacattcttaaaccaggagtagtttttctagtgctacgaatcttaacttttgttccagatacttcatcgacaaattgcctagtgattgacgctataccagaagcatgctgaatgaagtttaaaataactctttcaataggcagtaaatatattgctaatgcttctccacttactaaggtgctattttttcctgttatatctccatctttcttatgaatttcatactttacatgctctttattcatattaaagacttcttctagtataggaattccacaaactactaaattttctcttgtatttattgcaaaatttactttttcattaattaatatactattagtagttatatcacctttgtctcctaaatcttcttttaatgcattatgtataatttctgaaaatgagattttcatatttattacgtctttttgtacactatattataacaacattgaagtaatgtaaaaatcttatattattccaatatgaatttattacaaaataatatgaacatacatgctgttgtaatagtattatcctatttaataggatctataccatttggcttaatattatcttacattggagggctaggtgatattagaaaagtaggatcagggaatataggagcaacgaatgtttttagaaaaagcaaaaaactagctgtgatgaccttacttttagatgcagtcaaagggttaatatcagttttgttagctaaaatttatagtacggatcagacatttgcttttatatctgctatgttttctataataggacatatgtttcctgtgtggttattatttaagggtggtaaaggaatatctacacttttaggatcaatggtgcttattgaatataagtttgtaatatgctttttatttatttggattacactttttgcaatatttaagtactcttcattatcatctattgtgtcgactatttttgtagcgttgctagtgtacatgtattacacaatgaatgacacagccgtttttatagctatgtcactattaatcattacacaacatgctgacaacatagcacgaatgctaagtggaaaagaaaacaagttaaatataggattgtagtaaaatgttaaaagctttttttagagtaagcgtgacatagagcaacagctattgagtcagaaatatcataagtacctgaacatttgacattaagaatcttttctatcataaaggacacctgttctttcttggcatggccgtttcctgtaattgactttttgacatagtttgtagaatattcaaacactggtatatccttagtacttaaagttaatagtaaaatacctctagcataacatagtgatattgaagatttaggatttttatttatgaatatttcctccatagatgcactatctacctgatacaacctaaggatatcgagaacatccgtgtgtatttttcttaacctttgaccagtatcttccttactattggttactacagtacccttatctataagttttatatccttgctaacagataatatgctccatcccgtacaatttaagccagggtcaagacccattattttcatgttatgaacttatccagtacaagaaaaaaaacaataataaccatatgacatcaacaaaatgccaataccatgctgcacattcaaaacctatatggttttctggagataactgatttctttttgctctaagccaacatatagttaaaaatagtgtaccaactattacatgtactccatgaaaacctgtcatcatataaaaatttgaagaatatatggctttttccccagtttcacggaaggaaaatcctatatgtagatactctatagcctgaaatacagagaatgtaataccaagcaataaagtcatccctaacatttttactgtgtttttgttatcatcgtttatcaatgaatagtgagaccaagttaaagtacaacctgacaataagagaataactgtattcaataaaggtatagaccaagggtcaagtttagtaatgccagatggaggccaagataatagtttgctcggtactagattttcgagcatgtatacaggaaataaccaagctttaaaaaacgaccaaaagaagccaaaaaagaacattgtttctgaaagaataagggcagccatagccaacctaattcctttctttacaatttcagtatggcaattgtctctaattgcttctgtaactacgtctttccaccatttatacaagactatacttacagaagacataccaaatgcaagtacaattttgctgatatgtgatccatgaattgttccgactgctcctaacgctgttatcaatattgtgagagagaataacaatggccatgggctagggtttactagatgataatcatgtagcttccctttcattatggtatcctttaaagattatttttatttattaattttctatagtcaaagcaatagattgtcaagttcatattttacagtgttgtttttaataatgtattaaacaacagattttattgtgtctacaagtgctgcaatattagctataggggtacttggtattactccatgacctaagttaaatatgaaaggtttgtccttcattatattgattagttctttcgtttgggatattgccttacttttgtcatacgctactagatatggatctatatttccttgtagtactgacggaatgttactttttgcccaagacattggggtattatagtcgacacttgtgactgaaacttccgtttcttctgaaaactgcttgtacatcactcctgcacccttaggaaatcctatgatggggaattctggataaagtttacgtatagacgagactatttctttcgttgggtctattatccactttttgaattcgccggctggtacaattcctgcattgctatcaaaaatttgtattatgtctacaccgctttctatttgttttattaagtataaggttgtcacctttgtaattttttctactattttttctaggtttttagtttgtgaataacacatctctcttatttttgagaaatttttatctcttcctatcatataagaggctatagtccaaggtgcacctgcaaaccctatcaatggcttgtctctttgtaaggactttcttacttcttttatacccctaaaaacatttttaagatgatccaatgcagcttcttcgggaacgcttatttctgagtggttagatattagctgcaactcgggtcctttctctttcgtgaattctactttgcaacctaaggcgtcagggattaccagtatgtctgaaaatattatcgccgcgtccaagccgaacctccttactggttgtaatgtaacctcctttaccagctctggtgtataacacagttctagaaagcttcctgcctcctctgccaccttgcggtactccggtaagtatctaccggcttggcgcatgaaccagactggaatctctttttgcttggccctgcttgttatagtctttaacataaactctccattatagaaattatatatattatatccttacagatagtttttatagtttatctctgtgaattatgtgaataaaacttatttttgcaaaatatgtgagtagattttactgatgtttttttgtgaataactctgttaataaagtgtatattatactgattttctgctataatatgtgtgtataagtaatatgtgaattatgttgataactgtagttttaaccaacacctgatacgacagttattgcgaacttcatgttcctaataactctgtggataactatgtaacagaatgtggacaacttttactaacacatttcgtatcgggttattaacaaacttattaacacaaactttatatagaaaataaagttttgaatagtatacttgagtgataataaagaattacaaattgtatatgagtgataaactttctgataatagtgatagtgaagataggttatctttaaaagagtcgttaagcgctaagttagtttcatttatgatagagagaatgcctaaattaaaaagggttgtcgaaaacaatttgattgatgataacgagtgtttcaccaactcccgcatgttttataatcttagaaagttcaatgattgcttggtgagagatgtaatgattcctagaacagaaatttatgccatagacattacagatgtacctgatagcaaaaacttgatagataaggtagtgagcgggcagtacaccagaattccagcatatgagaacaatttggataacataatagggtttattcacattaaagacataatttcaaattttcataatgattttaatgtgagaaatataattcgtgaggttatgtatatccctccatctatgaaagcagtcaacttatttataaaaatgcaatcttctcacatacatgttgctgtagtagtagatgagtatggtggaacagaaggattagtgactatggcggatcttattgaagaaatagtaggtgatatagacgatgagcacgatgttcccactgttccaagtattgttaatatctctgataataaaattgaagtaaatgccagggtattagttaaaaacttggaagaaattttcaatattgattttagagattgtaaagaagatgattatgtaacaataggtggactcattttatctatgatcggtagagtacctatgacaaatgaagtttttaaacataaaagtggagctgtattttccattaaagaggctgatgataggtgtatttataaaatagttattgatttaagtgatgtaaaaaaagttgacttaaaaatcgattattgagcttaatctatctagtgtgagtttagcttttataaaagatgttgctaaatcttcatgtgtatctttaacattggtgacctttgaatatatattagcaggaaatgtgactaaactaacttcccataaggatattttctttagtacccttacacctgtttttgcatctatgtagtcatctattatactatatcctattgacaacgcattaatgataccatttttaatcattaaatacgcttctttccctttttgtaagtctagtagtaaatttgctgttatatagagtcctatattgtcttcagtcaagcttgtgatgttgcctatgggttctgtcgaattgtgttgccataatagctttattttgtgtgaattttttacagaattactaaaggcccctggtagtatgatatgcttttgtttatcaacgatgttgaacacacttgcatatcctgaaaaagtaccagattgttttatatttttttcagataaaaataaattacatgttttttgttgcataaaaaaacttctactaattatttgttaataaaattgacaatgagtgctgagatatatcatgtaatgtctaattattgaaaatttgcgaaatctcagaaatcattaaaattgtgataatatttttttatagagtatttccattctctattggtggtaacccaaaagctgctcttttttcattgatagtcatgaaagttgcattttctacgtattgccagagctgttttcttttttctgttaatacagagatggaatctttatcatatgataaaaacatattgcttccgaacctgggtattaaccaattgttaaaatgtgaaataatattgtctaagtgaggtaatattgtttgttcccatagtgaaagccttgcttcgataagattattataggtattatctccaggaataccaagcaattggggtggtacaccaaatgctaatgcaatgtcacgtgctgaactatgctttgattcgataaaatccatatctttaggggataaactcatttctttccaatctaatcccccttcaagtaatattggtcttccagcatttcttggaccagaatagaattcatctacttgtgattttaaacgagtgtattgttcttgtgttaaattaccattgttgttactttttgcgtttacaattaatgccccgcttggtctagctccattttgtagcattgcttggttccaagatccagcctggttatgttgatctatactgtatgaagctgcttctataggggataatccataataatcattaagtggatgaaagttttttatgtgtaggatttgtgaataatttgttgatttattaatcttatagtcatagtgataattatttatagaatagcgatatgaatatggcctattatcttttcctggagtaatctcaattctatctggccgcaaaagatgtaattctttgggaatcatatcatgattttctattgtcaaaatataagcattaccgctaataagtttataagtaagaattccttcgatgaattctgattttgaggtggtgttgtttggtttagatattaattttaataaaggatggttttttatttggaatgtgttgtttttgatagtcttatttagtaataaagaaacagatgctgcagctgatgcaatcatgtgaatagatctaaaagcaattacgttttttatgtagccattttctgcgaaatttgcatagcttctgtttttccatacagcctctgtaaatagttgtatgggaactgagaatgtgtaagaattgtcttgtattgacttttttttaaagaaattcattgataaaactctttgatatatataaattttattgagttgaattgatttagtaatatactaaaggtgtaaaactttgtaggtaatgtagtacaggttctatgtgagtctgtaacaagtaatatgtgtttgtcttatagctatgttagacttaatataatacatcctatgttaatagatgtggaagctgtttttatagggtgtgtatttaatttctgagctgataagtatttgtataatttgtaatgactttaatgtacgttgctattttgcctttatttatgaatattgtttttgttgttagtaattatacaatatgggtcttattactcaaaaaatacaaaaagcattcgataatgcagcaagttcgtatgataaatactctcatatacaagacgtgattttgcgtgaattatgtagcactgtggtgttagaaagttgtgataagagaaacatattagatgtagggtgtggtactggaaatatgagtaaattcttaaatgttgcaaatcataatttgattcaagtagatttatctcgggaaatgtgtgttttagctaagaaaaagaataatgcattgtcagtaaattgccatatggatgtaatgccattttatgaaaatttttttgatgttattattgcctcaatggttttacaatggtctcgtgatgttagcatttctttattggaattgtttcgagtcatgaaatctgatggtatattgtatgtggcaattccaatatttggaactctaatcgaattgaataatgtaattgaaaaagtaggaggatcttttagtcaattttataaaatgaatgaatttataaatatagtaaattcctttaatgttaaagtacaatatgcattttgttgtaattatcgtcaatatcataagtcatttcgtgctttcttattgagtatgaaattgacaggtgtatatacaaaaaaagttagtgatgaacaatataatatatttgaaataagcaagatttataaggaattatattctttgcagaattgtatttttaactcgtggaacattatgtatttggttgttaaaaagtaatttttttgtcataatgattaaatgaaagaacttgatgtcataacactattgcaagaaatacgtcatttggctcaggaaagtaatgctgtaattcttgctcattactatcaggattcagagatacaagatattgctgattttattggtgattctttagaactttccagaaaggcagccaccacaacagctgatgttattgtattttgtggtgtgtactttatggctgaagttgcgaaaataattaatcctgccaaaaaggttttattaccagatttaaatgctggatgttctttagctgattcttgtgatgcagagagttttaaaaaatttcgtgagttacataaagattgtgtatcaattacatatataaattctttagcggaggttaaagcttattctgatatcatttgtacatcttcaagtgctgaaaagataataagacaaataccagaagaaaaacaaattctatttgctccagataaatttttgggagcttttctagaaaagaaaacgaataggaaaatgattttatggcctggtacttgtatagtgcatgaaagtttttctgaacgagagttaattgatatgatggttagacatgataaagcatatgttctagctcatcctgaatgtcctgggcatttactaaaatatgctcatttcattggatcgacaactcagttattaaaattttcttctgataatcctaattcagagtttatagtgttgactgaagaaggaattattcatcaaatgaaaaaagtttcttctggaagcactttttatatagtaaaaacttcagatagtggtggatgtgtttcatgtagtaaatgcccacatatgcgtttgaatactttagaaaaattgtatttatgtttaaaaaatggttatcctgaaattacccttgatcctgaaattagtagtatggctaaaaggtctttggatgccatgcttaaaatgagttaatctttgttacgatattgttgatttattaatcttatagtcatagtgataattatttatagaatagcgatatgaatatggcctattatcttttcctggagtaatctcaattctatctggtcgcaaaagatgtaattctttgggaatcatatcatgattttctattgtcaaaatataagcattaccgctaataagtttataagtaagaattccttcgatgaattctgattttgaggtggtgttgtttggtttagatattaattttaataaaggatggtttttttatttggaatgtgttgtttttgatagtcttatttagtaataaagaaacagatgctgcagctgatgcaatcatgtgaataggatgtgcatgtgtttctggtgatgtagatagatccatttaatgcagataattctattttgtatttatataataatttacgttttttatgtagccattttctgcgaaatttgcatagcttctgtttttccatacagcctctgtaaatagttgtgtggggactgagaatatgtgagaattgtcttgtataaattcttaattactgtactgtaataaaaaatatcgtataagttgttgttcagtataaaattgtgtcatagtcacaatttagaaaaatgcagcttgatacatcatgaacatttaggtcggtatagatttgctaatagcaagtttatattacatagaaagcgtaatgctattcacttaaattttcatcaaaataaataaacttattttttgtgtacttgtgggattctgcgtctgaatatggaggtttagcagaagttatgttgttccattctttagagaattttttatttatttcataaaactttttaaggtttttctgttcttcgtttaatgcgctatcattgcattctaatacgtctcttataaaatcatctgggacgattgcatcgatgggacattctgggacacacacaccacagtctatacattgatcaggatctattactaacatattagctccttcatagaaacaatctaccgggcatacttcaacacaatcagtgtatttgcatcttatgcacctatccgttataaagtgtgtcattacagggttattaataataatgtaacggtttttattgtaatgttttttcttgccaagttcaattagtatttattattttacaaggtatagatgtggagttgtagttaaacttatacatcgtagagttaagtagtttggttaatgtttaggtaacatcctaatacgtatatgagctatcaattctatagagtatgttattttatgatagagaattgattgtggagttggatttggcaatacgtttaaaattaaaggagatttttatggatattgataatagtaacataagtacagccgatatacggagtaatactgatggcttgatagacataattatgcgtatattaggttttggtaataagaatattgtgcaaccacaggatctgggttctgaaatttatcagcaagagcaagaagatgacacagtctctcaaccttcattagagccatttgttgcagaaagtgaagtttctaaagttgaacaagaaaaaactaaccctgaggttttaataaaagatttgcaagatgttgcgagtcatgaatctggtgtatcagatcagccagctcaagttgttacagaaagagaaaatgaaattgaatcccatcaaggagaaacagaaaaagaaagtggaataactgaatctcatcagaaagaagatgaaatagtatctcaatcttcatcagagccatttgttgcagaaagtgaagtttctaaagttgaacaagaagaaactaaccctgaagttttaataaaagatttgcaagatgttgcgagtcatgaatctggtgtatcagatcagccagctcaagttgttacagagagagaaagtgaaattgaatcccatcaaggagaaacagaaaaagaaagtggaataactgaatctcatcagaaagaagatgaaatagtatctcaaccttcatcagagccatttgttgcagaaagtgaagtttctaaagttgaacaagaagaaactaaccctgaagttttaataaaagatttgcaagatgttgcgagtcatgaatctggtgtatcagatcagccagctcaagttgttacagagagagaaagtgaaattgaatcccatcaaggagaaacagaaaaagaaagtggaataactgaatctcatcagaaagaagatgaaatagtatctcaaccttcatcagagccatttgttgcagaaagtgaagtttctaaagttgaacaagaagaaactaaccctgaagttttaataaaagatttgcaagatgttgcgagtcatgaatctggtgtatcagatcagccagctcaagttgttacagagagagaaagtgaaattgaatcccatcaaggagaaacagaaaaagaaagtggaataactgaatctcatcagaaagaagatgaaatagtatctcaaccttcatcagagccatttgttgcagaaagtgaagtttctaaagttgaacaagaaaaaactaaccctgaaattctagtagaagatttgccattaggtcaagtgattccggttgttgtagagaaagatgaaatgtttgcaccttcatttaatccaatcgttataaaggaggaagataaagtttgtgaaacttgcgaacaagaatttgagattgtaaaggattcacagactgtaaaaggtagtgaagatataatatcacctatcgaatgcttagaaagtatggattctatagtttcaacaatatttgaaagtggaatgttatgtcctatgtcaaaacctggacagtatgtttgtgggtatgaaatgtatatgtatggatttcaagatgtgaaagacttattaggtggtttattaagtaatgttcctgtgtgttgtaatgttagcctttattttatggaacataattactttactaaccatgagaatattaatcacaatgtagtaaatgatattgtataattgtaaggtttagtcttgagatagcaagtgatgcttttattaagtattgcttgctatttttttgtttatttacctgctttttatatgggagaaatcatatattaagtgattgaaagtaaaagtggaattttgctgatattataggttataagcaattttttgaagtaaaaatgtatatagttagtgatatgtactaaaaagtagctgaattttattagtgagttagccattagtcttttgcctttttcagaagaactttgctgaaatgattaaaacagagtgatagttgttgttaatgtaattgataataaacggtgataggaatataagtcttcgtatatagctattcaatttagtataaaggcggaaaattggtgtgtgcataatatctaagtgtttgcttaaggtttgagttttggtaattaagaattaagtgctatcctgcgctattgtaatatgtttacgtatgtaaaagtggacaaagtagacttacctatagcgtggttgggaattaaaaataaaaagctgttctgcgctattgtaatatatttatgtatgtaaaagtatacaaagtaaacttacctatggtgcggttagtaattaagaattaagtgctatcctgcgctgtaatatgtttacgtatgtaaaagtggacaaagtagacctacctatggcgtggttgggaattaagaataaaaagctattctacgctgttataatatatttatgtatgtaaaagtgtacaaagtaaacttacctatgatgtagttgggaattaagaataaaaagctattctacgctgttataatatatttatgtatgtaaaagtatacaaagtaaacttacctatggtgtagttggtaattaagaattaaatgctattctgcgctgttataatgtatttacgtatgttaaaagtgacaaagtaaacttacctatggtgtgaattgaatgttggttaattacactttaatcacagcttgcgtcttataagaaaattactgtttatcattttttatatcttgatccttgacaggtttttcattgtgattgtcaaaatcattttcatggtgtgagttgcttatattattattttcatagtcatcatcttcattactattgttgtaatcgttgtcttcttcatcttcttcttcatcttcatcttcttcatcggtatagtcatagtcttcttcaggctgttcgctgtactcttcatcttcatctatgtactcatctaaatcatcgaagttaaaatcatcatcttcgtcttcatcatcttcataatttgtttctgtactgttatatatagcaccttcttctgttagattattttcagtgttgttaggtttgttttcaggaatatcactttcaatactagggatagggtcttcattttctttttttgttatttttacattattaggatcgtaaggttcttgagtaggtacgaaagtgcttttcaataatttttttgtaaagtttttgtcttcataatattttattttttttgattttataggataagtagactctattaaaagtatttgttcatctctaggtaacattataacttcttgaggtaataataacgctctttgtgtttctgatatgtgtaatgaacgagaggcagggtttaaatctaaaaatttaggtctatttaaagattcctgattaactgttttattgcctattagctgtgatattaggtttgcagtttcaatattgtttgctgcaaaagtaattctataagtagaatttgacagaaatgagttcattcctgcttcctcatatatacctttaagctgttcagtgtcttggataatcaaaaataatctaactctatatccacggaaatatgcaataccagtttgaaattgctccatctttcctaatgttggaaactcatccattaaaaacaatacaccgtaaggttcatcatccgatggtaaagttcgacataaaaactctgttgcttgctgatagaatacctgcattaaaggcctaagacgagttaagttgtctggtgttaatccaacatatactgttactttttttcttttaaattcttgaatattaaaatcacttgaagctgttgctgtatctattaacgggtttgcccataattctaaagatgagttcatagttgatactacacctgaacgctctttatcagctttttgtaagaatgcagctatattcatatatgcaactgggtgaatttttttccctatagtgtctaatacaactgccaagttgtagactacgtcatcactacgcattgttcgtacaacttctccaaaggattttactttttctggtactgctagtagatataatactactcctacaaataaactacgtgcttcgttgtaccaaaagtcttgttcaggcattattagattggcgattttttgtacatcatccaccatttgtcctggtttagagcttatccaatccaatggattgtaacagtgacttaccccatcaggttgagctggattccacacaaatacttcttgtcctctttttttcctccatccacttgtgagatcatagttttctaattttatgtcatgtactattacagagtcttcccaaaacaataagtttggtattacaaaacctacacctttcccagatccggttggtgcaaatagtaaagcatgttgaaatccatcagcaataagataacctcttttgtcttttcctagtagtataccttttctactacgtaatcctatttttcgaatatctttttctgttgcccatcttgaatctccatgtaatgattctttctttttaaatggtctccaatcgaatagtatgtttcttaaattccacaatactatacttaggatacctattggtatacatagtgatgatattaactttactaatagtattgcatcgtatgaagaaggattatgccaccagtgttctacgtaattaaaaacagtaggccaaattctgtctggaaagtcgctgaaactaggatttatagcgttgaaatctagatagtctggtccccataccattaagataaataaaacccctgatagataaaagcaaaattccaacccgaagaatgctcctaagaccaggaataaaatattacgtatgtggtttgcacttacactatccataaaaataacaacttaattataaaacttacgtatcatttaaccatttttctgtaaagatttagtgaataatatttctgatacataccttttaccctctgatcctctttttaactgtattacaatatctactatattagtgatgtaattaattatttgatctggaggtatgccaagtcctgcttgcataaccattaattttaattgttctagtgccatcattggtgtgtcagcgtgtaacgttgatatggaaccaggatggcctgtattaattgctcttaaaaagctaaatgcttcagatccacgtaattctcctactattatcctatctggacgcaatcttagacatgcctctattaaatcttgagtgctgactttagctctaccttgtcctccttttgaggcaattaaatggactctgtttggatgattacttaaaacaatttctcttgcatcttctactgttattagcctttcattctgaggtatacttcgtaatgctgcattggtaaaagttgtttttcctgttgatgtaccaccactaattattatgttttttttgtttattatagcatgttctagaaattgcttgatctttttttgctttaatagttcttttaattgattatctgtattattttcttgagtttctgttacagcttggttaaatgcgcccattttttcatagtcatctaatgaaagttgcattgctgatggttttctaattgacatgactactgtggttgcttcacaggctggaggaaatacgatttgtatacgatagccattaggtaaagttgctgataataatggattttcttcgcttatcttttgttctgtagcttgtgctattagtctgcctaatgcttttaaatgcgataaatttagggtcggaatggattcacaacgtatatttcctctgttttctatccatacttcacattcctggttaatagatacttcatttaccccatcttcatgaaagatggattgtagtggttcgagatacgtatctaaggcggcatagcttgttgtcatataaatcctttataattaattaacaatgtctattccacgaactgctgactttgggaacacaatgtctttattaacaaatacttttagcaaagtaccttggtctacgtatactgtaggattattattagaatatttctttattatatcttttatagagtttgaaaaatcatctactgcctgagataaaatttttacaggtaatgtagtttttgtagatttagacttatcacctgtgtcatctttctccttatcctttttttctttgctatctgactctaaaataggatagttgttaatctcagggatttttgatgtagcataggatgttgctatagatacaccagctaacagtattgttgaagttaatatattgcctatttttgtatcaacaacacctgaagctccttgtcttcctaattcatctgttccgttggagtcaagtgttatgtcaataccatgagggaggataactctattccaagatatttgaactctagtttttccggggctagcatcaaaagaataacttcctattaatctagatccttttggaatcattactgtattgctagcttcagcatagacgtctcttgctactattcctcttagtgtaccttgtaaatctgaattaatagcagtttctaagacgacatcaattatttttccttgtaaaattgttaactctaaattactcacttttgttgctactacattaggagaagatgtagtttgtaaagaaataatggaattcatcttgttaattgtagtatcaatatttgattctctctctccgttttcagaagtgccagatgctacattttgtcctcctgaaactgctaacattgatgtagctcttctttctttgtcatatcctgttgttataggtgcaataggagcagctatgtctattttattttgaacgggtaaaggtatttttggtaaaggttcaggttggggctgcggtttaggtttaatttcaacaggttgttttggtttaatttttggtattttgggtatctctagtactttaggtttttcaactgtcggaattgatggtaaagatggtgatactaaaggtggtaactccggtaattgaggtggaatgtttataggtggagatacttcttgggttggtggtacagattcttttaataatttttctatgtctgcttcttctgttgtttgtggtttgttgagactatcatctggttttttgcctgtgaagaaataataataagcaaaccctagtccaactaacatcactcctattgtgataaatttttttcctttatttactccaacaacgtttacattctcttcaatttctgtgtattggttgttttgattttcttctgacatagtgtaccatggtaagttttattataattttttattagtaatttttacagattcacttttatattctagatataagttcttatgtacaccctttattattacataattttgtaataataacattttgcaaggtacttttttctcagagttattgtatatgaaaatttgtggaataatttggttatcatttgagaacttaaaatatgtaagttttccgtcatcaaataattctacaggtagtatgttttgattttctgattttgtctctaaaatatagtgattacttgtattgttaggttttattacaacatgcttttttattttttgtactgcactaggcacagaaatgtctggcagctttacttgatttagttcgaaatcttcttcggtttttggatagtagaaacgtactatatatgttaaatctattagatcagaatagcctgcttggtcattattgtcatcactagattcatttgcactacgacatataaggtcaaaggcataacttcttcctttgtttgtttctattaacatatttgttcttccgtttttttctaatggcattatgaatagtttgttaccaactggttttactttccagcttacagtgttacccattgctaacattttgatagtttcaccttttgaaaattcaatgtacgagtggtaaccatagttaaaaactacattatagatttcattattactgtatacgaaagttttaatcctactgtctactgttacaggattatcaaccctgttgatggcatatgcactgctgttaaacatcattactaaaactaatagtagtattgtatagattttatagaaattcatcatctgccctatagtaagttatctggaatcctaaaggattaatttgccgttcttgttcattcatttcaagagttacgtattgaaatgataatgtagctattctatctttttttattatgccacttggatggttaaattctaaggagaacctgatttgtacacttcctggacgcaaatgctgtaaagatctgattttaagatatcctgatgttacatttgcatataagtttaaaggacttgcaggattacttagccttatccagttacggaactcactgtatgttgtttggttagaaaatagacgaacttttgtgtaatagttatattgaaaattattagggtcaaaaagctctctagatcttacatattctattataaaatgattatttaaaacttcgtctgctgagtattgtttgactgatacagggtttactaaagttgtgattccagattttttctctatttctactacaaatggttcaatagttctgtttttgcttatattaaaaatgacgaaaacgctgattcctactgcgcttaatgctagcatggtaaaaaacagtagcatatttctttgtataacaactgagttataacgactgacgtgccaactgtatgttgtttctaaatttgcgtttgatagtttgttattatcatttttattattcttctttctgaatttattaaacatacgtatcatcaaccttatagttttaagctatacttacaaaaataaaaatttctgttaatcagatagtcgttgcagagtgtataccttatttatttacatcagattaacgttcatatgtaaaaatagcataaaaaatacttctagcaaacgtgacctaaccttttagctttagtattgatataattaatattatgttgatttgtgtcaacaaaaataggtaatatttttgtaacttgtatgccgtgattctgaatttctgaaattttatttggattgtttgttaataattgcaatcttgaaattcccaatttctgtagtatttttatagctgggatgaataccctttcatcatcttcaaatccaaagaatctattagcatctacagtatcaaaattgtgttttatttgtagttgatatgttcttattttgttagctagccctataccacgaccatcctgggctaagtataaaattattccacctttattttctatcattaactttatggcagtatgtagttgacatcgacaatcacaagataagctgttaagtaggtcaccagtgtaacatgaagaatgaatcctaatgataggattgctataatctggattttctataataattgcgtaatgttcaagttccccagtatgtgatctgtaaacatttattttagcattggaacagtcttttagaaataaaggtgaactacatacttcctgaatttcatattctttattataattctcgattatttcttgtcttataggtgtgatgttgtttttagtacaccaatgtagtacatcagaatcattgatatcaacaacaactgctgagggtaatagttttgttaattttattagggaaatagcagttatatctaaagagtttgtacttactgtcacattatcaataacaagagatcctttgtgtaattcttgacctgttagtagggaggatatatattctagatcatgagattctttaattttgattcttgagagttggtttcctgaagattggaagatgaagtttaatctattaccggttactaatatgttgatatctttaaaatgttttttcaatgtgtttagtaattgattatctattaattcgctggggaagatgagtaagctatcattgctgttatatagcaatactgggataccacatcttagttctgcgatagacttttctgtaatatacttgttggagtgaaatctgttaaataaattttccatattatgctcaaatattacatggtgcggttgagaagactcgaacttccaaggtttttatcaaaccacagcgacctcaacgctgcgtgtctaccattccaccacaaccgcggttcatagcctttaatcctaaataaattcactgcgtgtgtcaacgtagcttgttaactataaattaataactttctttgatttttaaaagatattctataatacaatgcttattataattgagattagatttattgtaaaagaatttattatgagtatagattggtcccattactttaatattgtgaacataatacatgtgatgaactttaatatagggcatatgggaaatgttaatatgattaaataatacacgaagttgtgctaaacatgcgaaattataatactctataagtttgtataaagatggtcatgtatatcttaagctgttgaattggtgtagaagtttttttagattgtaaaatttataactaactaactgatatgtactttaatgttaaggtattatattggtgatgtattacatgtgctggttttaaacttcaattttgttagattgtgcaacaaaaagtattccttcgacttgtgatccatatattttacagtagctagaatagctacactgtaatcctgattctataatagatgattttatatacttgtctgaatggcaaaagaaatctccttcatttataaattggaaacctgatcctttctttcttcttgcaagtccgataataataccatctgtctctaacattgtttttagtaatttaagaataggatttaaactgcctgtgtactgtagtacttcagttagaatgataacgttgtattttttcttgttttggtttttcttaagaaaatcaaaaatgcttatatttattaattcattataagcttgtttaccgtttacaaaacagcctcttgctatatttatcattttgtttgatatgtcaatgcctgttatatgattacctatacttttcatttttaaaaattgaccacatataccagtaccacatccaaggtctaaaatatttaagtatgaagatttatttccaaaaaagtttattattagagacttaacatattcatgtgctttgtattgttttgctataagccaatgttctacaaaatgttcgctagtgtaatcgaaatattgctttataatgttttcaggcacatatacaatactttctggatttgttattttgtttaagtagtataaagcatctgcataattattatctaattctattgcacgtgtaaaattttgttgtgctttattgaagttttgtagtgtaaagtaacatcttccaatattataatatactactggtaatttaggtttaaagatactaataaggcgaaatctgaattttgcatcagatatatttcctttgtaaaagtggtataaaccaagatctatattagtttcaagtaagttttttagcttattttgtaatagaatggcttccttttttatggaagtgattttgttttttatagattgagaaatatcttgtggtttcggtatagttttattaatactcgatattaaagacgatacattacgctttgttatgaagaagttacttttcatatgccactcgtcaaatttttgtttaatactaatatagcataaatatgttataatgaataaacataaacatattgttaaattggtaaaataaagttttcatataactttctgtggtgttctattgattgaattattatattagttttttgtgcaagatctttatacattccgtattttttatttaattcatttttatgagatatatgttttaagaaactcaaatgcatgtgtgatattataaaatgtattatttgcgtgtctataagtcgggaaattacattattgaggaccttaaaattttttccagtgatttttgatagtaaaaatagcattaacttaatattgaaatgaatgagtatcattatatatattacacaacatagtactacactcaagcaaccaatcattacagaacgtagatagtttgattcttcgctttcttctaaggaaaaaactcctgttgcacaaagcatcttcattttatggtataataccattataggtacaaaacaaaaaaccaacagtccatttatgtttgcttcttttagtttcataaaaacccatttattactgctgacattgtagcataactatatactgtataaaagtttattggtctaagaaagtaaaatagtgacttattagacacgataaatgccattgaatatatatgataccatcccttccattaaaatagtgttatcatgttggtatgatattaataaatcaccaccttgtaaacatacgactgctgtcttgttggtgtattgacgtcttattgctgcgactaatgctgcacatgctccgctgccacatgaggctgtctccccagttccgcgttcccagaccctaagttttattttatctctggatacaatttcagcaatactaatgtttgcccttttggggaaaaggtgatgattttctagttttggtcctagtttatctagtggaattgtctctatggaatcaacaaaaaatattgcatgaggattccctacatttattcctacaggatcgcttaacatttctaattctataggtaagtgcaaagtatcacattcttgagatgtaggtatatctgtccaatggaattttgctactcctatgttgacttgtactctattttccgatgtccttaaacatgataatatacggtcagatagttcaattgttatattattatcttgtttttcattgcttaataagtatccaacacatcttgcagcatttccgcacatttcaactttgcttccatctgcattatatatgtgcataaagcaatctgctttttcagattctgttataataatgatttggtcacaaccaatacctgtttttctattggcaattgctttatagttaatgttactataagattttttcctacaatctatgattacaaaatcattagaggttccatgcatttttataaaatctatcattacaatattaagaaaaaaatggtaacgtaattattgtgatcgattttaacgagttttcaaatatttatttttgtagatagatacagtctattactgctaacagcaataaatgctatgtaaataatgtattgatcctagatatgccaacgttgttaaggctgttatatttataaaaaaatataaattactacaacagtaaataagttttacataatacttgtgtagaagtgtagatcttttttatgtaatggttctaacattttatatacttatggagttttttaataactgtactgcttctttatgttcagcaataaaactttcttctatgttttttggaagtttgatattgaaatttgagatgaaaaattgagatatgtcctgtaatcttgctacattattcttttttttgctgataaatttataagaagaaatgccttttaatatttcaatattgaggagtttatttaatagtactgattccattgttgtattaattcttaatagtatgttgctgatgatttgatcttctggtaaggatatgttgtaatctttagaatgtattgttattatgtataagcatgatatttgtaataagtgtgtttgtttatatttttgattttttattatttcccatgttattttagtggattttgtgtcatttttattattgataaatggcatatctgacatttctttaacctaagagaatcaattacgatattatagatactgatagttaaataatgtataataatggcatttgttttaatgttgatagtaaagagttatatatttgtttaataagcctataatgttgttttttatttatggtggtactgtttattataaatattttaacttgaatgattattgaatgcgtcaaatgaatgttataattgctgtagttgatcttactagaaattaaatagttctgctcaagttacaactcgtgtgtagatatttgtcaaattttattgaaaatattgcaatttttattgtagtgctagacgtaatgggttctagcattgtattttcgttaaatattttatggcattgttaaaatagagggtgcaaaggaatattatagcctttcgaatgtttgttatgtgtataatgtagttaatggtgttaatgattggcatagcgttaaagatattaatattttatttaataaattaacaagtataaaagtattaatattttttaattttttattactgatagtatagtcttggactgtatttatttatatgttaattttgccaagtaatatgatgacaaagttttgtgttactatgagaataaatttgattttataataaaaaacacttaataaattttctgtagtttataaagatatttaactattttagtgatttattaaattgttaaacaaggtaacttatatgttaaagcctcatgattttacttttcgtaatatgaaaaaaatacaagattttagttgtagtggtaaaactgtattgctgcgtgcggatttaaatgttccagtagataatgggatagttttggatgatactaggattgttagattaactacaactataaaatatttattgagtaatgatgcgaaaattgtcataatgtcgcactatggatctcctaaatcttatgataaagaattttctttaaagtttgtggttgagtatttgaataaaatatttgcaacaaatgtagtatttatagatggtgtaattggagattatgtagaacagactattcaatctgttccagcagggactatattgctgctagaaaatttgagattttacgcagaagaagaaaagaatgatttgaattttgcaaaacaacttgcgttgttggctgatatatatgttaatgatgctttttcttgtttacatcgtaagcatgcttctatagatgcgattactagagttatgccgtcttttattggctttaattttcaagaagaaatgaaatatttgagttgtgttgtttcaaatagtgagaagccagtagctgttatagttggtggttcaaaaatatcaacaaaagttcatatgttaaaaaatttgattaaaaaaatagattttttgatagtgggaggagccattgcgaataattttttgttatcacaaggtttaaaaataggtaagtcgttatacgaagagttagaaaaagatcttgtaacagaaattgtagatcttgctaagagatatgaatgtaagataattgtccctgttgattacgtagtggctaaaaattacatttgtggggatagtacaataaaagacaatgacactttagagtctgatgatatgatattagatgtaggacctcaaactgttaacatgattgctgctacgataaataaatgtagaacagtgctatggaatggtccgtgtggtatgtttgaaaaagaacctttttctaaaggaacatttagtgttgcgaacttgttgtcaaaattgactaaggtaggaaagctaaaaagtattgttggaggtggagatagtatatgtgcaataaaattatctggactttcaaatgaagactttacttatatttctacaggaggaggagctttattgcattttttgagtatcgcatgattttaaaagtaatataaagttcactttaaagtgtatgtattgtctaaatatgacagagttttattggtaatcagtttaaaatgtgttttctttaatgtagtagtttaacgaagcaatatcagtttttattcttaatatgctacagcattgagagtttctattttgttagtatttggtacatatgtatccgaaatctgtatttataaagaataatgttgattgatattagtttaattttttcaaagagctatttctgtattgtaaagcacaaaatatgtaatagatatgaatttttttatcatatgttacttagaaatggttttgtttgttgtgatttagaatatggatacattgatttgagttgtgagtagtaattgcttatggcgtattaaagagcttatattgaacagttgttaattgatttgatgttgtcagattggtatgttgacaagcaggggttataatttcttattttattatagcttctattataccatcttttagttcaattgatataatatcatttgattttagtttttttatactgctgatgtggttacggtttgtatcgtataatacagcatatcctgcttctaaagttttttctttgttaaatttattgattttattatatagcgcgtttagggattgtttcttatttaatagcagtatttttagcaatacttctattttgtttttgtattcagatagttgaagttttagtactttaatttgatgtttagttttgattaagttgttgtgtaaataaaacagcctctctttttttttatttattttatagtgtaaagttgtctttattttgttgaatttactgtttatatgttctatgagttgggtttttgttggcaaaacaatttctactgctgctgtaggtgtaggagcacgtacatctgctgcataatcaattaaagtaaagtcagtttcatgaccgattgcagaaactataggaatgctagatctagctactgcccttactattgattcatcattaaaaatccataaatcttctatactgcctcctcctctggcgataatgattacgtctggtttatttgtatcggcgttgtttagttttgatattgcatctataatttggttgatagattcattgccttgtacggatactggagatataactatgtgacttggaaagcggcttttcactctgtttagtatgtcgttaatcactgctccagtagtagatgtgattacacctgtaattttaggtagtaaaggcaaaggttttttgtttgattgatcaaaaagtccttctttttctaattttgcttttctttgttcaagcattattttcaagttgcctattccggctagcaacatgttttctgttattagctgatattttgattggtaggttgttaggaacccggagcatatgacttccaatccattttttaaatcaaattcaactttggtattgttccagcatattgcattgagtacagcagcatcatcttttaatgtgaaatatgtatgcccagattttggttgtgataaattgctgatttctcctctaacttttatatgagtaaacgtttcatgtacaaaattttggaaaattttagtgatttcactaacagtaaattctggtgtcataaaaaagctatctcaaacaagtttcctatctttatttgtatgctatcagtttcttttggtacatattgtattatatgttcaaatttataatcttctttactaggaataatatcagttttgtgtttatttaatttttctgaagaaattgcttttttttgtttattgtagaatacaaaatgtatgccgggtataaatctttcttgatcagattggttcttaatcactccttcaacttttattgcaatgctatctttgttattctttaaaatttttatttgagaatttgcgagctgtatatttgttgtgtcgtacatttctattatacggtaaatcttcctgattttatatggcatgttattttgcagcataacagaaagtgaaaatactaataatatcattgcaactattgatgatattttttttacaagaaaactactcttagtagaattattaaggatagtgttcttattgctttgtaagttgggatttgttgcatgttctttatttatgtagtccttttcaggatgatctatgttatcttgtgaggggacatgcatccacgtattattgcagtttgtgcatctaacttttttaccgctagtagggaatttactgctatctaccctataaactgcgttacaatttttgcattctatccgcattaacacaagtttgttgattatgtattataacatatatagtgtattattctcaacatgtctataatgtatgtaatttacatcatctgatattataactggggctattatggtataggttgtaatggaataaaatacttgtattttattgtccgttttgttagcatgaaattttatgaaaaactagttgtaaatatggaaaacttttgtaattttaaagacgctattgaagatgcgtggaataatttagctaatctttctagtaatacttcaattaaaaaagttgttgatgatgttatggatcttttagatcagggtaagatccgcatatgtgagaaagtaggagatcaatgggtagttaatgaatgggcgaaaaaagctatattactgtgtttccgtgtgtatgacatgaatcttgcagaaattagcagtgcagactcaatgcttggtaacttatgttggtttgataaagtgcaattgaaatttggtagatggagtgctgatgattttagagcagcaaaagttagagctgtacctgggtcaatggttcgtaagtctgcttatattgctcctaatgtagtattgatgcctagttttgtaaatgtaggtgcatatgtaggtgaaggtactatgattgatacttgggcatctgtcggaagttgtgctcaaattggtaagcattgtcatatttctggtggtgcagggataggaggtgtgttagaaccattaagttctagacctgttgtcatagaagataattgttttattggtgctcgtagtgaaattgttgaaggtgtagtagtaggtgaaggttcagtaattgctatgggtgtttatattggggcttctactagaattgttgatagagcatctggtgaaatatcttacggaaaaattcctccatattctgtagtagtgcctggttcttatggtagtggtgatttatcattatattgtgctgtgattgtcaaaaaagttgatgataaaactagaagtaaagtatctattaatgaacttttaagagatgattcttaatacataactataaatctatatatcattagtttagaatataaaaaacaaatgtactttataggtgaagtaagcgttttagctaagttgtatcgtatattttttgctaaaatatgctagtcaattacttggtaatgtgtcactcagttgaggtggttttaattgccaaaaattaagtttagtgtgaaatatggaaacttataaagagtgtatatattctaactagtgatataatagttatgatacaagttcttaatataaaaagttctctgtcttgtttttgtgagtttgttgatagttacttgaataagaaagatcaatatatagatcatcgttatatgttaacttttttgtacttaagaaagcttatgttgtttaatggaatataattttctatttaataatatagtgagttttattctaatgatgataaaattctagagtacttctactatttggaataaatgactacaatttttgctttatgtactccatggggaaggtctggagtagctgtgattagaatctctggtgaagatgctgcaaaggcatttgtgcattttggaattaatagtagtattaaaccaagaactgcaacgtttactcctttatacgacaaagatggtgaagttatagatgaagcgatagtggtgtattttgttgcaccaaatagctttactggagaagatgtagttgagtttcatactcatggtagttttgctgttattaaaatgatattagctgagcttggaaaaatttttgttcctgctgggccaggtgagttttctttgcgtgcttttttaaataataaagttgatttgactagagctgaagcaatagtagatcttataaactctgaaacagaaatgcaggctaagcaagctataagacaaatgtctggggttttggaaaagttgtatcaaaattggcgacagcagttgattgatatattatctaatatagaagcttatattgattttccggaagaagttaatagttctgctatagctaatattgattatctattaaataatttgcagaaatctttagaaagtcatcttaatgatgaccgaagaggtgaaaggttacgtcaaggtatttatgttacaattcttggtgaacctaattctggtaagtctactttatttaatcatttagcaaaaagagatattgcaattgtttctgaatatgctggtactactagagatcctctagaagcacatatagatgtagctggatatccaattattattattgatactgcaggcattagagagagtactgatccagtagaacaagaagggatcaaacgtgcgaagttaaaggctgaaaatgctgatttcaaaatagtaatgcttccttacgagaaacgagatatttttaacagagaaattatgagcttgatagatgataagtctatatgcattttaagtaaagctgataatattacagatcagaaattaatacctgtgtttgattttagttttattccgatttctgtatattgtaacattggaattgaaaatttattgaatttaattaaacaaaaagtagaaaaagattttcaattttgtaatactgacccttttattacttctgaaaggcagagaaaacatattcaaaatactttgaatattataaagtctgtagatttaagtttacctatggaaatagtgtcagaggatttaagattgtctgtaagggaattagggaaagtggtaggtgttattagtgatgatgatatattagataatgtatttggtaaattctgtataggtaaatgatatttacctggattattagtgggcatgtgtgtaagttcttggattcataattttattaataaaatacatatagtgattttttgttgtggagttattttgataagcttatttcaagttataaaagtgtaattctatggtcaaaaaatttggcaaatgtattttgcttggtaattacatatgcagcaattttattttttgtcagttttgtgaaagttttctatgaatgagactatctcctgaacttcagccattttacctgttccgtattcgttacaaattgctaacccttctttaggttcaattattgttacgttatcactttttaaacaatgaatattacgttgatttgcttttgaattccacattgcaggattcatagctgggaccatgatgataggaatgtttgaagcaattaacgcagttgtagctaattcatcagcaataccatgtgctgtttttgctattatatctaatgttgcaggcgctactagtacaatatcagaacttcgcgttaatgatatgtgatgcatacttttatgggcatgaaaaagatctgcatcagtatacacagaatttccagataatgatgctactgataatggggtaacaaacctttctccagatttgcttattatgctagtaactgtatggttattttcttgcagttttcttatcaaatctaaagatttatatgctgctatgcttcctgatattactaataaaattttcataggataaaactaggtaaacattcaatttctatcatatatttttgtatattcaaagtttaatatttataataactttgacgtattagtttaatgtaggattatagtttaatgcacaacttaagcatattttctagcatgtatatgttgccaggagttaataatgtagtagggagtttattaaaaaagttatgtggtggtgataaaattatagatttgttatttcatataccacaaagttatgtggatagaagaactgcgttatctgaagattctgtaggtaaaattgtaacttttattggtactgtgaagtgtcatggttttattggtaggaaaagaaaatcccagtataaaattgtgcttgatacatgtattggtgaagtatcattaattttttttaattactcgttgaaatatctgagaagtgttttaaaggtaggttcaacatgtgtagtaagtggtactctgataagatttttgggatgtttgcaaattacacatccggattatattgtaacagatattaaaaagttccaggatattagtatcatagaacctatttatccactaattagaggattaacttctaagagaatttcaaagttagtaaagttaagtgtaaggttgttacctgattttcctgaatggatagatgaaaaattgttaagagataatagatggaatagttggaaggaaagtttaataaaaatacatcacccagatacacttgaagctgtgcatttacatagggcaaggttagcgtatgatgaattattaagtcatcaaatctctgtaaaaatggtcaggaaatttgattaccaacaaggtgtctctattgtaagtaagcagctatactataatgatattttaaataaactgccttttaagttaacagaaggacagaaagaagtaatatctcagattacaaagagtcaagcatcagaaaataggatggtaaaactattaataggagatgtaggtagtgggaaaacagtggtagctttgtttgctattttaaatgttatagagaatggaggtcaagtagcttttatggctcctactgagatattagcagaacaacattatcgttggatacgggcgatactatctgatatttcagttgatgttgagttgttaacaagtaaggtaaggaagaaacagaatattaaaaagaaattgcaacttggtgaatgtaatgtagttattggaactcatgctttatttcaggatggtgttgattttaataatcttaatttgattatcattgatgaacaacaaagatttggagtattacagaggatgaggctaattaataaaagtaatatggctgatgtgctttttatgacagctacgcctattcctagaacattagagcaagtagtatatggggatatagattgtttaagacttaaggataagcctcacaatcgattgcctatacaaactagtattgtgaatattgagcgcttgtttgaagttatagcaaaattacaattggctttgcaagaaggtaataaggcatattggatttgtccttatattgaagattcggaattattagatatagcagcagcagaaaaacgtttttttactctacaagaagtgtttggtaaggatgtaggtttgatacacagtcgtttgcctaagattgaaaaagatgaagtcatgatgtctttttataatggaaatattaagttactagttgcaactactgtaatagaagtaggagttgatatacctgatgctactataattattatagaaaatgctgaacaatttggtctatcacagcttcatcaattacgtggtagagttggccgtagtgataaatcttctttttgtattttacttcatgggaatatgttaagtaagattgcatataaaaagctatgtatattgcgtaaatttcaagatggcttttacatagctgagcaggatttgttgttgcgtggtagtggagatgttttagggataaaacaatcaggattatcaaattttaagtttgcagatatttataaggatcaaggccttatttctattgctgttgaacaggcaggagcaattctggatgcgaataagacagaattaggtgatcattttaatcaattgttacacatgtttggttatgatgtttctactataaattattagtttttatgtgagtaagggattttgataaatttcaagtggtagtgatttttagagaagagtatatcagtttaagttttgaatagaaaattctggctataatattacaagatttagaataaaagttatgcttagatggtttctatgtaatttttagtgattcaggaatgattttgttagtagagagttatgttctcgtgaataatgttaattttattttttgtagtttttgatattattataagtacagttacaaaaattgtattagggctctgcttatataaaaagtgatcttaattttgtaggagttattttttctcaggcttttgtataaaaactatgaagttgtttctgtaattgttgttactgtgaagttgaggtattagtatgtctataaagcgtgtcgttatgtttggggggagtggttttataggtagatacttagtaaagtactttgctgagaatgggtatgtgattaggattgttactagatatccagaaaaagcaaagcaattaaagttatgtgggaatttgggtcaagtagaggttataagtggtaatgttgctaatagtgaagaagtaattgagcatatacgtgattgtaatattgttataaatttacttggtgttttatatagtgcaaagaaatctactttttatgacatacatgctaaagcagcagaaaatatagctaaagctgcaaaaaggtgtaaagtaaagttgatgattcatttttcggcaatgggaattactgaaacacaaaaatctgactatgcgaaaagtaaattgataggggaaaatcttgtgaaatctgctttccctgatgcagtgattataaggccaaacttagtttttggaccagaagataagttttttaataagtttgcacagctgtcaatgatttttccatttttgccggttataggcggtggacgtgcagttttccaacctatttatgttgatgatcttgctaagtttgtatttagtattgttgaaaattcgattacagataagctatataatgtttgtgggccttgtacttattcatttaaagagttattaagttttatcctgaacgttacaaatagaaaaagtaagcttattaatatttcttttggtgtaacaaatattttagcttttttttgtgagctgagaataatttctatttttttgaaacttattactggaactacagatccaattttaacaagagatcaggtgaaatttattaaagatatgaccgaatctcatgatatataccctatgaatgagttaaaagagattggagtaaagttgtcaactattgaaaacatagttcctaaatatttaaagatttataagagtttttagtattatagctatatgtttgcatttgatgcttattttagaaaagtttagatgtaattttttgaagatgtggagtatctctcattccttaaataggtgaaatgacggaataagttttcaattatctgaaatgtataatcctgaatattacggacttataagaagaggttggagtaaaattttcaactatgaaaacatagttccttaaatgtttaaagatttataagagtttttaatattatagctatatgtttgcatttgatgcttattttagaaaagtttagatgtaattttttgaagatgtggagtatctctcattccttaaataggtgaaatgatggaataaattttcaattatctgaaatatataaatcctgaatattgcggacttataggaagaaataggagtaaaatttttaactgttgaaaacatagttccttaaatatttaaagctttgtaagagtttttagtattatagctatatgtttgtatttgatgcttattttaaaaaagtttagatgtaattttttaaaggtgtggtagtatctctcattccttaataggtgaaatgacggaataaatttttaattacctgaaatatataatcctgaatgttacaaacttataagagttgttttattttataaatactagtttttgcttagctttcatcaatagtttgtagtccgcaacttaatgttattactatataagttacgatagtatacctatgtttaattatcatttaaaaaattattattataatcattttcttgatcattactgtaaagtttttgttgtttttctctcctttcctgttcttctatggagtataatgttattggatttgcttcaagtcttgcgatgccgatcttttctcctgtttcctcacaataaccatataatccatcatctattctttgtatagctttgtttatctctattattaatgcttcatttcttttcctagtatttaaaattagcacgatattgtgttcttttgttgccatatctgttaagtctgcatcagcttgtggacgtagtaattccgtagctagttcttcagattctttttgtagtacttctcgccatttaatcagtttttgtctgaagtattctaattgtttatgattcatgtaattgctatcatcttcatcttcaggaaatgcggtattatggttttttttcaacatttgtattccttatttgtgatacaactaaaataataatttaaatatagttgattaagaattcgtgtatgatatgtgatataatgacgatgtttttatcagttgtgggctgagtatgggcaatagtagtgcattaatgtatgaattaaagttatcgatgagtaggaaaggtaatcttttaaatgcaattattctttttatattaataattagtacagcattgtttactatgaaaaatgttgaaataataaaagtacttccaactattttatggatttgtagtatttctgctgtacatatgtctatgtgtcatttatttgaaaatgactatgctaatggctctttagagcaaatgttgatacaggaaagtatggtagagttgataatattttttaagattttatcgcattggatttgtgtaggaataccagtaagtattatttctatgtttatagattttataattctggaaagtaacatatatactactctaggattagggttgtctctaggaattagcttgctagtaattagctttatatcagctgtaggtgaagcgttagtattgggtagaggtagtggcataataatagctcagattttgacattacctattatgataccggtgttagtatattttagtcttgtatttgatagtataataaatggtgtatacagagaaaatttaatgttgcttggattaattattgctggggtagttcctattagtgtgatatttgtatcatttgcaattagagttgctgttgaatatgattagctatacgaaatattttttgatgtttgattttatatttaacaatttgaaaaatagtatgcgctaggaagattttagttacttgaattaatatgttagttaattactgttagtgtgatatttgtagttagactgtctgttgagtatgattgacttttacaatatattacttattatgttaacttgcgggtaattagctcatttggttagagcacttgcttgacgtgcaagaggtgactggttcgaatccagtattgcccactggtctgacgtaatttggttataaaatgtcgcttattcataaaaataagccttccaaccatgaaaataagctaatatatgctatttttattattatcattacgatggttgtagaagtagttggggggataatatcaaattctttggcattgctttcagatgctggacatatgtttactgattttatttctttgttattaagttggttagcatataaagttgctatgaaaaaatcagattcatgtcgttcctatggttatcatagatttcaagttgttgctgcttttattaatggactcactttgtttggtatagccattttaattatcttggagtcgataaagcgctttttttctccagaagaagtttgctgggaaattatgatgtctgttgcaatattaggattgatagcaaatgttgtatcattttttctactgtatagaaaaaatgagagtaatttgaaccttaaaagtgcagttctgcatgttgttggtgacttgttagggtcagttgcagcgattgttgcttctgttgtgattatgtttacttcatggcagatagtggatcctcttttatcagtatttgtcagtattataatacttggtggtgcatataggattattaagaattctggtcacattttacttgaaggtactccagataatatagatccggataagattagaaaaactgtttctgaaaacattgctgaagttttggatatacatcatattcatatttggtcattaactacagatcatccaattatgacaatgcatgttaaacttgataaggcagctgtaactgataatttaaagtatagtcaagtattagtatctatcaaaaaattactgagcagagattttggtattattcatgttactattgaagctgaatacgataattgtgctgatgatagtgttatgattaagacagctcataattaaattaacagtatggactgtaattaagtgactaacaattatttgataggttagtatctttattatgtttttcttgattgagatctttaaaatgttaaacggtggtaatgtcacatcgtatagcataatatgaaaaagtcaatggtattaaatgtatatttattaatttatgttatagatatagcctgtaaaatcatgagaacttgatattttatagagtattcattgtaaatggtgatgtgtattatgcattatcgttcacagtaagatgagcagcctattatatagtataagtaagtaaataaaatgattaatagttatatttgtaggttatttgttattagtttgctttttttgtttaacaatgcttttgcctatgatgctactgaagcatgtagagagcatgttaggccatgttattttattgttgcattaaaaaatcaagttgaaattactgttagagacataaaagataaagctaaaatgtatgccggtattcaatccatagttgatagggtacttaatataaaagatatttctagatttgttttaggatcgtattggaatactatgtctgctgatgaacaagaaaagtttattagtgaatacagtaaatatattaaacgaatgtatagcaaacagctatgcaagtattctgtttatgatatgaatattttgtctattaagagtccaaaagcagatcattacttaattaatactcggttatcacatgagaaagatgtcaataattttttgatggttgagtttaagttaattaatactggtaatggatttctgttgtctgatataaaaattaatagtgcaattagtttttctattactcaacgttctatgattaagaatatgataagtaaacagggtattgatggaatgatatcttatttccaattagaaaatgcttctgctaaatattaatcttgtgaatatctaagttaaagaaagtttttgtattcaatacagattatcatttctacgattgtggttatttgttgttttaacttttcaagtgataatttatgttgttgtactcaagatactgtattaaatattggttttgctctgttgtaatgtaagtgtcataaatagaggcatttttattagaccagggttttgttatgtctacaactaaaactgtggcttagggtgaatacattgtaaggtcgtttatattttttgggatggtataaacccattataaaatatgctaacctgttcgttagatattcaatataactgcgattttttaattaagagcatacacacggagtgcaaagcattgtactacactcttatgaggataccttaaggaaaattagtgagcctttgtaggaaaatagatactacaaaaacctactactgtgaataaaaaagtactgcgttttaatgaagtaaattctatacagcttttgcctgctgttgtaaatcaaatgcttttaactttaaagccatgcgactaatttttcttgctgcagtatttctgtgtataatttttttgttaacacacttgtgtaaatttgactcagcctttttaaaggtttcaatcattagctctttgttccctgcagctaaggcagccataaatttttttacgtagttatgtgctctgcttttccgcatgcgattgaccatagtgcgtttctttattactttaatcatctttttagcacttgggtgatttgccatatttaaataacctatcttatccttcactatataactctataagtaaattttaatcaatgcaagagcttttatatatttgtgatgatttagcaagttaaagaagacagtaatgtttaaatgttatgctgctgtttataatatgcttaacttcctgcaaacgatacattaacataattcagaaaatgtttagaaataaggtttcgtgctttactttaaagcttctttaattagtaagttgcttgctgttgaaattcttgtttcaagttcatttgtaaattcttgttttgttagtccaggataaataggagctaaaatttgtaaaatagcttttccaggtctttttttagcgggaaaaatactagctggccaaaataaaccagtattaactgctattggtactacgggaattgataacttattatacatggctgcgatacctggttttatagttactttttctcctggtattattcttgaaccttgaggaaaaattatgacagttctaccttcttgaacacgtaaacttgttgctgctaatatgtgtttcagagcttgaactttttgtttacggtcaataaatatcatttttagtagcataaagtatataccaaaaattggaaaatgctttagctctttcttgagaatgtatactgggtctttaaatatagtgaatagtattaacgtttctagaggagactgatgctctgatgcgatgatatatggggaattgtcaggtaaattttcatagccgcgtatttcatagtctactttatctataattttgcagaaagatagtattacttttatgccatgaactgaacactttatttttaatgacattgggaatatcaaatataatggtaaaaatatcacagcatgtagtactgtaaaaagtgttgacaatatgtaaaacagcattatgacctgacatttatattagttttgctatagtatagcctatagttctaaacgataaactatttttaatattatattagtttttctatttattactcatatttttgtaagtattgtatatctgtagtaataaggtagtagataatcatgcaatgtgaatatgtagaggctcatcattgcgtaagttattatctattttcttgtatagtataagtgtaactatataggatacagtgcttaatttgtatggttgtgtcagactcacacatgtatttggatcatttaatacctttattcaatacaatcgcttcttttagtgatacgcaatgatagtgaatatgtaaaaagcaaaagtaattcatagaatatttctgtgaagattgtaataaaaaatgttttttatagtgtgttgccttagtgtgattttgtttaatgtaggaaggttagaaaaagtttatactttacaataaatatttagaaataaagtcttgtgctttactttaaagcttctttaatcagtaagttgcttgctgttgagattcttgtttcaagttcatttgtaaattcttatgggagtaaacattaaataaaagctcaaatataggttgttatatgtttgatatgattttaatagaagtatgatatctatattgatttcggaaaatatatattttggaaatgacattaaagttcctgaattcatgttctaatataatgatcataatggcttttaatttaagtaattagcagtctgatttgttaataactttgtaaatgagtaagtatgacattttctataagtaggtgtgttaattagtcaaagtataacagtctatggtactgtgaatgaagtactgatgcgctatcagcaacattgtaaatcttgaattaatatttgtttcatataatatgattggtaggttttatacaaacagttgtaaggaaataaatgtcagttttgtcaattgttactgttcctgataaaagattgtcgttatgttctgaagaagttgaaaaagtagatcaatctataagaaaactagttgatgatatgtttgaaacaatgcatgctaatcaagggttaggattggctgctgttcaggttggtgttcataaacgtattcttgttatgaatgttccagaagagtttgaagattctgaggatattgagaatgttgaggataaaatagaaggttatgaactatatggaggtccttattgtataattaatcctaaaattgttgatatatctcaagagaaagtaaaattaaaagaaggctgcttatctgttcctggttattttgattatatagtacgtcctcagcgtattgctgttcaatatttagattataatggtaatgaatgtataataaaagctcaagggtggcttgctagatgtttgcaacatgagattgaccatttaaatggaacggtatttttaaaatatctatctaaatttaaacgtgattttgcaatagaaaaagtgaaaaagaaagaacgaactgatcttatataattgttggtattgatgtgagtgacttggacctattggaagtgttgaaattttatcatgagaatggtattgattgtacattagaagatgtgcagtataatgtttttacaagtaaaaatctatctttgcaaaatagtagtgatacagggtattgtatgaaagaaaaacaggcaagtattaaagaaaatacggaggattattatctgttaaaagctcaaagtcttgctgaacaatgtaatactatagagcaattaaaaagtgctgtagaatcttttgatggatgtgatataaaaaatttagcaacaaatactgtatttgctgatgggaatcctaaagcaagagtcatgttaataggagaagctcctggtgcgaatgaagatttaaaaggtataccgttttgtggtgctagtggtatgttgcttgataaaatgttgcaggcaataggttttgatagaactactgtatatattagtaatgctgtattttggcgtcctcctggtaatagaagaccaacagattttgaaatagcagtatgcaagcctttcgtagaaaaacatatagccttaattgtgcctcaaatgttagtattagtgggaagtactgcgtgttatgctatgcttgattctaagaaccctatatctagacttagagggaggtttcattcatatagtaatcagtttcttcagcatagtattactacgggtattatatttcatccatcatacttattacgccaaccaatgcaaaaacgtcttgcttgggaggatttaaagcagattaagcgttattttgatactttgtaatattattctagcatgtaaatgtaagtttaagaatgaatattgctttgagatgtgttcacgggtgtttgatttgtgttgtataaatagctctgtaaaccagggagagcttgtgtagtgaagagttgcttagaaggattaaaaaactaagcattatttttatactttatatgtttaatgctagctttattatgcgaatgtaagtttgagaatacatattatttaggcatgtataaaatgagtatgcttggtgtgtattgcatgtgttgataagtgagttggcaattagacgtaatacagtaaaaaaattttttctatatggtttaatagtatattgcaaatttatttattaatttggtcaatggttttaatataagtttgatgttttgtataatgttaaaaaatgtacaaggatataaaagtttttttattactactggaaatctaatagtagttgtaatagcttgtacttatttttaatgctggattatcgaaattaattgcgttgttaatctttacagcgagaacttttcatcaaggatattattgcaagagtgttgctgtattatttgctacatgaaaaaatttaaaatattctttatgttttgtaaaattttgttgcgtaaggtcgatatctgttaaccatacttgacattttatatctctgatgatttctaataatttttcttgatgatatgcatctaggtgagacataacgtcatccaataataggatagggtattctccaatgttttgttttgcaaaaacagaagataaaattaatgatagtagtagaattttttgttctccggttgagcagtaatttgctattaagtttttttctgaatggaatatttgaaaattatcgttatgaactccaaaattgactaaattacttagtgaatctttacttctgttgttttttaaatgttctttatatagctcaatagaattttcttggtctaataaattgaatacttggctttgaatttttatgattgctttaaaaaaagcatgagatttgctattttgagatagagtgttttgtaatgtttgtaaaacattaaatcttatacgagcaatgtttatgccattttctgcaattatgctttctaagctagataaccaaaagttatctatagagttgttatataataacttgcttctttcctgctttgctttgttatattttataatatgtatagcgtattttgtatcgaaaatgtgtgctattctgtcaaaaaatcttaatcgttcactttgtgattttaagaaaatatgatctaattgtggtattaaccatatgatgcttgtaattttatgtaatgtagtatagctttggtttttattgctaattaatatagcgcgtttgttgtgattccgtgaaattgcaataggataaataccgttttgtgtatgcatttgatatgaaacactccatggggaatttgaaagactgttttgcatgctttctgtgttcactcctctaatgccagtgccttttgatagtagagaaattgcctctaagatatttgtttttcctgcaccattttttccaagtaatacaactgatttactagaagtatctagctcaaggtttatgtagttacgaaagtttactagtcgcaaattgtttatgtaagatttttctatagatgacatctaataatattccttttttacttagaatggaaattttatacttatatcaattttttctgcaagaactactcacttattatattgaatactacgaaagtcttgtattaattataaagttgaaagtttctttatatatgaaatgtataattttgtgactgatttatgaatcagtaatgagctttttaatataataataaatttcatatcaaatttataatttataatgtggtagagaatcatctgatatataggattttaaagttgttttttaatatatagtgctgaatctgtaatttcgaaaagttgtgtgaagattgtgtatgtatttaaagtgtctgaggtctatgcttatgagctttatgaattagcatcatatattaagcttgtgacctggtagggaacaaaactaagacttaaaattatttagagtgtaaggtgtaatcctaatttgttgtttaaatggattattgtatttaaaaaatttatttgagaggtgtatgaactctgaagatgtgtgacatgcaagtttgtgttatagcagatttaaacaccataacatgattgccttttgaatatgtaatctattttctgcttcatcaaatatatatgaatttggtccatctattatttcagatgttacttcttctcctctgtgtgctggtaaacaatgtaaaaacatgtagttaggtttagctttttcaagaagtttggcattaacttggtatttgaaaaactcggttttgatattattttcataacccattgaaatccaagagtctgtagtaataatatctgcgtctgaaatgatgttatgaggatttgcatcatatgtgatattattacctttctcttgtgctgacttaagcagtaaatcaagattttttgaatattctaaagttgaaatgtttagtttgaagtttaatactgttgcagcatgtatccaagacactagcatattgttaaaatctccaatccaacttactgtagcattttctatagggcctgtcttttcttcgtaagtcataatgtcagctaagacttgacatgggtgactatgttgtgtgaggctattaatgactggaactgtgctgtgtttgtctaattcaagtagagaattatgttctaatatccttattactattaaatcaacatatcttgataaaactttagctgtatcgtagatggattctcctcttgtcaattgagtatccttttcattaagaataatagcatttccacctagttggtttattccaacttcaaatgatatccttgtacgggttgatggctgcagaaatattaaagctatatttttattcaataggtgtttgctatattggttaggtttttttttgattatagaactatagtctaagattgttcttagttcctcttttgtatgtaaattaagatctgtaaaagaacaaatatttgctttattcatacattttataacctggctctagaatttgacttttactattgatgtgaaaaacaatattgctactagaattattagtagaaataataagatgtaatttttgcttttcttgttgcttgacgtcttcactggaaaatgcctttttatgtaaacgagataatctcaagacaagggcatttcaacataaaatatgtttgatgtcaatagtttttgcttgtgtatactttatacttactgttcaaggcatcattgtggaagttttttgcaccattaagtgtttacgtatacacaagctttgatttggttgtgaagtagagtataaaataacttgaattattgtgctgatgagaaataccctttgagtgaataccataaatctttgaaaaaattggattgttttgtagtatttgattcatatatgatttctgtttcattggattctactttcttaaggttaattaaatccatatcactcagcgtaggatccgtaccatatgatgtttgtgtggatggtgatgtagtctgggtagtattgttggtattagtatcccagaattcactgttatttgtagtagtattagtactatgggtttgtgcggttaatgatgtatcttgaacggtatcattagtattagtacttccaaattcacttgtacttgtagtagttgcttttttggttttgggtttggttgttgtattttttcctttttgtgttttgggagtgttttttgttgtcatattagtatacccataattgtacttaacctaagaatgttaatattattttattaaataatagataatttagctgtcaaaaaaacgtttcttaattagttttatattgtatgtgtgtgtacatgttttttgtaatatattattgaatattgagggtgtaagaggttttgtttagatgttggtgattgtgatcgtatcagatccttgctatgttttaggtacgtaaaaaaattactaaaaatttttataatacatttgattatggaattatctatactaacagggttgtaaagtgtaaaatttgtagttttatataacatgttaaaataatgcgtgtttttacaattatagatgcttatgggttgctttttagagcatattatgctttaccaaatctgagaacatcctatggattacctattggtggggtttatggttttatcaatatttttttaaagtatatagagaagcatgtaacagattatttagttgttgtgtttgatactggtagtaagaattttcgtcataatatatatccagaatataaaggtaatcgtcctaaacttcctgatgacttaatacctcaattttcattgttaagagaagctgtaaatgcttttaatatagcttctgaagaagttgtagggtacgaagctgatgatgttatagcaactttaagtaagaagtattgtaagttgcaaggtgttaaagtaacggttgtaacgtcagataaggatttgttgcaacttttaaaatataacatttgtatatttgacccaataaaaaataaatatattgaagaagaagatgtacaaagtaaatttggtatatcatcaaatcagttgttggattttttgtctttaacaggtgatgcatcagataatgtccctgggattccaggtattggtgtcaaaacagcagcaaaattacttaatgattttggatcgttagataatttgttgctacatgtacatgaagttaaaacaaataagtgtcgtgagtctattactcaatatagtgaccaagcaatattatcccgtcagttagtaactttatgtgatgaggtagatatatgtggggatatagaaaaatatagttttcagatctctggaatacaagagttagtagaattcttaaaaaaatatgaacttcaatctttgatgaataaggttgataaatttttcaaagtaggtaatgcctcatcagctgttaatcaaaataccagtagtagtgataaaactatgggtggtgataaagttatacatcatgaacctcaatcttcgatgaatgaggttgataaatttttcaaagtaggtaatgcttcatcagctgttaatcaaaatgccagtagtagtgataaaactatgggtggtgataaagttatacatcatgaacttcaatcttcgatgaataaggttgataaatttttcgaagtaggtaatacctcatcaactgttaatcaaaatgccagtagtagtgataaaactatgggtggtagtgaagttatacattactccactgagtcacttaaggtgtttcttgaaaactgtaaaggtgaaggaataatggcattttatatggaaatggctgataacgttattgatagtgtttctttatcatataaggatgatattttactctatattgacaaggatcatgtgactgatgcactagaacttattaagccagtacttggtttaaattatgtgttaaaggtaatatatgatgtaaagacattattaaaagttattcctgatgtggaaattgtagcatttgacgatattatgataatgtcatatattttaagcccaagtgtacatgatcattcactacaagagataattaactataatgttaaacaggatgttgttaatgtaaaaacagcaataactttattattattgcataagttgttaaagaaaaatctgtttgtaaatcaactgtatactatttatgagagagttgagaagccgctaattcgtgtattagatagcatggaaaaggtaggcatgttgattgatattgatattttaaaaacattatcatctactttttcagaaaaagttagtgtactagaaaatgaaatatataggcttgcaggaacagaatttaatattgcatcttcaaagcagttgggaactgttttatttgataagatgggtataaaaaaaagtaagaaattgagttcaggtagttatagtactgatgctgaagttttaaatgatctggtatttaatgaaattgaaatagcggataaaatattacagtggcgtcattttacaaaattaaaaagtacttatactgatgctttaggaaaacagataaatagtaatagcggtagaatacatactttctattctatgatatcgactgctactggaagattaagttcaagtaatccgaatttgcagaatattccaattagaagtgaagagggaaatgctattaggagagcatttgttgcacgaaaaggatataagttagtttctgctgattattcacaaatagaattacgaataatggcacatatagctggtgtacaggcatttaaagatgcattttttttagatcaggatatacattcgataactgcagagcaaatattttgcactcaaagcctggataaaaatctaaggagaaaagcaaaatcaataaattttggtattatttatggtatgagtgcatttggtttggctaaacagcttggtatttctagatcagaagcaaatgcatatattgataattattttaaatcttatccggaaattcagtcttatatgaacaatattaaaatttatgcaaaaacttatggttatacacggactatttttggtagaaagtgttttataagagatattaatagcagtaatgctgcagctagaaatttttctgagagggcagctattaatgctcctttacaaggaacatcagctgatataataaagatgtcaatgattcatttgtttgataagattacacatggatcacttatacttcaagtgcatgatgaactattgtttgagattttagaagagtatgtagattatgcggtggaggtcataacaaaagtcatggaaggtattgttaaattatcagtaccattaaaagttgatattcgtataggaactaattgggctgatttagttccatatagtaaaaaatgatgagctcagttatataatagtgatgcggaataatcagtattataaagttgtgagtacagaaaggaattggattggtttatagttcctgtagttaaacaagcttggttgtactgatttggtgtggtacttatattattatgaactgtagacatgtaaaatgctgtgttaaaaatttgagctaggatatagggaataaagagtatagtgttactattagataaatgtaatgtagagtagtgtggtttagtgaattttgtgcacttgaaaaagaaaatgttaattttacagaaaagcacttttttaatattttcaatttagagttagtatagtggttatatatgtttttatttttacaatttaagtaacttctttaggcaagggatttttggtaaatttgcaatatgtatgatattagttttatgaaaaggattaaaaatgttgattgttttttgcgtacttgaaaattatgtgaaattcaatagactgtaagttatatatttcattatcaagattcacgtgttaacgaaaaaaaatagttttaatcgaggaaaagttgtagaagtctctagttctatattgtcagcagattttgctaatttaggtaagtcagtggaaatgttgacagatgcgggtgtagattatatccatgtggatgtgatggatggtaattttgtgcctaatatcactataggacctgttgttgtttctgcaataaagaaatatacaaccatcccatttgatgtgcacctcatgattaattctcctggtaattatatagaggcttttgttgatgcaggagcagatatgattactattcatgcagaatccgatatacatttagatcgtataatacagaagattaagtcttataagaaaagtgctggattatctcttgttccaacatctcactataatattttagaatatattatttttgagcttgatcttgtgttgattatgacagtaaatcctggctttggcggtcaacaatttatcacatctcagttagataaaatttcatgtgttcgtaatctaatagaaaaatattcattgaaaactaaaatagctgtggatggtggtgttaatattaagaatgctaaaagtgtaattgaagctggtgcagatattttagttgttggatctgcaatttttaatgcaaataacatgttagattatgtacaacaacttaagtcctctttctaggtttgttagtgaagttttttgaatgctgatgtgtattttccttttaatgatattatagccttttcttatgtatttatatgtaactgtaatatagagttaatagttacctttgatgctgtataattcttgtatgtccgaattatcagtttaaaaagttaagatattatgtaatgtcttgatataatcataaaacagaattttattatattgtaacacgtcatattaatgtgagtaattttatgaaatcttaaattttttatattagtgtattacataatgtagtcttagcaggtataatatagattgctagcgtaattttgaattatgagtttggtgttgtaaagttgttttggatgtttgtaatttataaaatgataatttcataagagtaagttttttgttatattttattaaatcttaaaatattattttaatatattaattagagtaaatattgtaaaatttgaaaggggttacactatagtttttaatgcattgatattagtgtaagtatttttatacctgttaaaataaaaggttttattgttgcgagcagtagattgtaatggattgatagacagtttatttatgtgtgctgcttaaaagtatttggtgtattattatgcgatttttgtgtttacatttggtgccgttttggttgttagaaactattggtagatatgtaataaatgtcatttttaatgtaggacactcttttattttttttgtgaagtttgtatataattgttttgtgcctccttattactatggggttatattaaaacagtttatagagatattctttttctcacttcctatagttggcataactgctatatttactggtgcggttttaattttacagaactctttgataatacataataatgtttcaggtgattttgtttcaggagttgttgttgttgcgatcgtaagagaactagggccagtattaattggtctgattattgcaggacgtgtgggagcagctattgctgctgaaataggtactatgcgtattactgaacaaatagatgctttgtttacattagatactaatccattcaaatatttagtcgttcctcgtattatttctgcaatggttgctatgcctatattgattttgtgtgctgatttaattggtgcttatggtggatacattgttggctcgtatcagttggggtatacttctgaaatgtatattaaaggagtaataaaatttttacatgctaaagatgtggctttaggtttggttaaggctacggtgtttggctttataatatcctttatggggtgctatagtggctattattgtagtggtggagctagaggtgttggattggctactacttatgttgttgttgtgtcatccatgtttatcatcttattcaattatattattactgtattttattcatagtagttgattttatgaattatatttctttatctgatttgcatatagactttcatggacatcaagtattgaagggaataagtcttgatattgcatatggggaatctttggttattgttggagaatcaggtagtggaaagtctgtgttaacgaaaacaatactggggttaatagctcctacttctggtaaagttattgtaagtggtgttgatattagacatgataagagtttgattaaaaattttggagttttatttcaaaattgtgcgttgtttgatagtttaacagtgtgtgaaaatattgcttttaacttacattataggttcaatcgtgataaacaattatcgaggaaaattgctgcttctggattgaatttggttgggttaagtagtgatgtgttagataggtatcctattgaattatctggaggtatgaagaagagaatagcactagctagagctattgttagtgaacctaaaattatgatattggatgaaccaacttcaggcttagatccgataatgtctgatgttgtgaatgaaattataataaaatgtcacaaggaatttaatttaacagttattactattacccatgatattaatagtgcttttaaaattgcaagcaaaatagctgtattgtatgacggaaaaattgttgcatgtgaatctgtgcaagatataaaaaatatagataatcagtatgttaggaactttatatgtcgaaattagagttaagattggtctcattgttagatagaatgatgatttttattatatgtgtagtagctttatatagttgggtattagtatgttaataatgcgtagaatggctatagcaaggtatactaagccccttatatttagtaaaatattaaactttgatccatcatttattaacatgttggaatctttagaagcagaagacatcctcttgttaaaagatgaacttggttcggtattttattatttaatcatgtcattgtatgatgtatctggtattcaaaatgattctagtggtgctataagagaacgccttaaaagggttttgttggatgcaattgagcaatctaattcagatcaaagtggagctgtaggttctcaagttagtgaaataagagaaattagagataggttaagatctgcataccaatccatttctaatagagtatgcagaactttaataagtgcattgggtaatgaaactctgcaagaggagacagactcaaatattacacagcaaagtaatctacaacgcaggttacaaatgtttcagtatgtaatacaagctgtggaaatattggctgataaacttaatacagctgttgtggagggtaaggtttcgcctgaacaagtttctgaatacttgtcttgtacaaatgaatctcatgattctattgctcctgatactatgagtgctttggttaagttatattccttaacggatgatcctcaacttacagatttagcgtattcattggtaaaaacattcttgatgaagtttggccgatataagttggatggtcaaggtaggaattctatgcattatgctgtaaacatgtgtagtccggaaaggcaagaaagttttttgtgtgagatgatacagccatcaatatatgaacgggtttcaatagttaatgaggtggatgcatctcgcaataatctaatgcattatgcagcatgtgctccatacatgaattatcaaattttaaagtatttagtaaaaaattttcctgcaatgatgacacaacagaattgctatggagatactccattacatattatgtcatatgtatattttgttaattttgcaaaaatactgtcatcttataacattacatatagagagaatatgaatgctttaaaggaggttgtagatcgtgggttgcctctttctcagatgagagaaagagttatgtcaattagaagaaatgatgaagccttatcaagacaacttaaagcttacgtagatgagagtgtaggaacttatcaattgttgctcactatggtgcctttgcggcagatatttgaagtaagaaataatgcagggcatactgtatatgatataatgaatgctagtatgagcaacataggcaatgagcgtcttgaggctttattgcaagatttttcccaagcaagcagtagattacctatatatgattgtaggattgattcacagcatgaactatgtgtgaatttatgtttttcaaataaatatagagttgttggtaaaagtggatatggacatgtattgtatacgcatgtgaagcgtatgtatgacttgatatcctataagttttctgagatctctgattctagaatgagatgcataaagattgaaaatgagcgtggtaacaacaggtatttaagtatgcttgttgttatgatgttaatggctttgtgtgttctaaataccgttttacattttaaaacaagatctattttaggtattgagcaaggcttatatagatctgtattattttcagcgatatctgtggttttctttgtgagtatttgtgtattttgtattgtatatgctaaatatgttgatgttgctgataagaagctaataatcgaggaagaagggtatgcacgaagtatattattatcacatttagatgttcaagaaacagatactagtcagagaagaagagaaggttaaaactttgcctatgttgaattaaaagtttgttgggtttgaatatcctctataaaaccatgttagcattctctatataaaatacaatctagtagtttgtttaggtgtgttttgtagtttgattctgcaaaaatatttaaacatgattttgcctgatttatgtaagttgttgctatacttattgatttttcaatcgcattgtgaactttaatataagatattgcctgctctaggtttggattgacagatatttgatcccagaattttttttcttttgacgttgcattttgatacgcaatgataacaggtaaggtggttttgcctgttaaaaggtcatttcctaattttttaccaaattgttctcctgaagctgtatagtctaaaatgtcatccatgatttgaaaagaaatgccgaaattatttccgaagttttttaatgcttctttttcttcattacttgtttgggctaaattggcggcggattcacatgttgcgctaaatagagcagctgtttttgcagaaatgatctctatatatttttccttagaaatatttatattatgactagatatcatttgttgtacttctcctactatgacatccttagatgcttgagatagtatggataatatattcaggttcttacattttataagccattgaaaggatattgcgagtaaaaaatctcctactaggatacttgctttgtttccccatataacattagatgttttttctcctcttcttagttcactttcgtctatcacgtcgtcatgtaacaatgtagcgttgtgtatcagctcaatagctgctgcaattggtactttattttcgttgttacaatttagcatcttgcatatgataaaaaaaattataggacgtattcttttacctccggatttaattaagtgttgtacgatttctgtgattaaagtgatatgtttattattttgatgtaaaattaaagattccattgaatctaaatcttgttgaactagtgattttaattgtagaaatgtattactaaagtcatttgtcatgtttaataagtctccagaatttttatgtactgtgttattgagttggtttttatttttatctgagtatacatcatgaaggaataaatacaaatatagtagtaggtaataaactcactatattgtatttacgcccagattttattttaagcgagtgtaatatataaaacagctgtaagcagtgtagtgttgagttgcttaagagctatagtaatttataaattcgatagggtgtggatgcagctgtaggtcctttacttctagcattttgagatttatatatgcatcaatttgatcattggtaaacacatctcctactagcagaaattctctattattatctagggagtccagtgcctcttcaagagagcttgctacagaagtgaattgttgtagctcctccttatctagtgagtacagatttttgtctattgctggtccaggatgaattttattttgtattccgtataacccagccattagctgtgcagagaaacataggtatggatttgccagtggatctgggaaccgtgcttctattcttttagcattgaggtcattttttggtacatacggtatgcggatggcagaagatctgttttcatatgaataagtcaaccaagttggagcttcaaaatgaggtactaaccttttataactatttgttgaaggatttgtgaatgcattaatagcttttccatatttaataattccacctatgtagtataaacaggtttctgatatactaccatcaggattgacaaaaatgttaacgttgtctttccacaaagattgatgacaatgcataccgctaccgttatcttttataactggttttggcataaaggttgcagttttaccataagatgatgcaactccatgtactatatacttacacttttgcacattgtctgcactgagtagtaattcatcatgttgaaatccaacttcacattgtgatgcagcaacttcatggtgatgtattaaaggtataatacctacttctttgaacattgttaacatttctgatcgaatgtcatgtaacgaatcaataggaggagtaggcatataaccacctttaacttttgggcgatggctattgttggaaaattctcttttttgaaataaaatatcgtgttctgcagaatctattttgaagtaagagttatacattcctgcataaaactgtgcgttatcaaatataaagaactctacttctgggccgaaataacacttatcagcaatacctgtagatagcatatatttatatgctttttgtgctatataccgtggatctttagagtactgagattgcttataaggatctactatattacacaatataaccaatgttgattgagcagaaaatggatccatgaaagctgtactaacatctggtagtaatatcatgtctgatttttctattgattgccacccaggaattgatgaactatcaaagttaactcctgctaaaagcacttgtgcatttatagtttctgcactacgtgttatgtgatgccatttaccattagaatctgtaaaccttagatcaataaaatttattgcatttttttttatgtagtttaaagtatcctctatagaaaggaacatgatgaaattaccaagcttaaaaacaaataggatatcaagtttcttatggttttgcaacatcatgatttataatttgttagggaattagttagaatgctatgtatttaattgagtgattatcttcaagaaaaatctttacttaatttcaggaaggtgattcaatatatgcattgtaattttatacctttgattgagatcccgtagctcagtcggtagagcgtctgacttttaatcagcaggtcgcgcgttcaattcgcgccgggatcactgtttttttaatgatctgtttctaaaatgaagttagagtctcaattcttaagttttttgtattctcgagggtattgtagtcaatgcactaatattagtatgttggatcaattaatgagccaacaatgtgtacatgcatatatcgggtttgattgtactgccaaaagtttgcatgttggtagtttaatacaagttatgattttaaggcaccttcaaaaatttggtcacaaaccaataatactactgggagatggtacaactaagataggtgatccttctggtaaagataaatctcgagctatgttatctgctagtgaaattgaggaaaatgcattaggtatctatgaggtattaaagaaatttattgtatttggtgatggacctcatgatgcattgttagtacgtaatgctgaatggttaaatggtttaaattatatagaatttttaagagatataggtaaacatttttctgttaacaatatgttgacttttgatagtgtaaggttgcgtttagaaagagaacaaaatcttagctttctagagtttaattacatgttattacaatcatatgattttgttgaattaaatcgacggtataattgtttattacaaataggtggatctgatcaatggggtaatattgttagtggagtagaattaggcagaaagttaagattaccagagctttttggtcttactactaatttactacttacaagctcaggtgagaagatgggtaagactgcacaaggtgcagtgtggcttgatggaaatatgtatagtcctgtagattattggcaatattttcgtaatgttaaggatgaggatgtaggtcgttttttgaggttatttacggaattatcgcttaatgaaataagaaatttagaacttttgcaaggacatgagattaatgagtcgaagaagatattagctactgaagcaactaggatatgtcatggagaagaaattgctcaaagtgttgctaatgatgcacttaaagtttttgagtgcaatgatgattctggattatcagttttttatgtaaagaaatatgatgtagaattagggttgcctataataaaattacttcaaatgtgtgaaatggaaaaaagtagtagtagtgcaagaagactgattaatgataagggatgtaagattaatgatgtggttgtattagatatgaattataagttatccttaaaagacttttacaatacatcctatgttaaattaagttgtgggaagaagcgtcatttaaaagtaatgttagagagtgatttttgatagggttttatattaaaacataggatagaggtaattatgatagattatgaagagatattttgtagcaagattaagcgtataaaagatgaaggtcgatatagagaatttacaggattctcacgtattcctggtcagtttccttatgctatagaatgtgatgtaaataacgtagttactctatggtgtagcaatgattatttgggtatgggacaaaatgaacatatgattcttgctatcaaaaattatagtagtagtgtaggtgctggtggtacacggaatatctctggcactacaaaggagattattgagcttgaaaaatcattagcagatttacataaaaaaccagctgctctgacttttgtgtgtggctatattgcaaatcagactactattagtacagtgctttctgtaataccagatattgtagttttttcagatgagaaaaatcattcttctatgatagaaggtattagatctactaatagagcaaagcatatatttaggcacaatgatcttaatcaccttgagactttgttaaaatctgttgatatatctgtacctaagatcataatatttgaatccttgtattctatggatggagatatagctccaattgcaaaaatttgtgatttagctgataaatataatgcaataacttatttagatgaagtacatgcagttggtatgtatggaagtcgtggaggaggtatatcagaacaagaaaatatatctgatagagtgacaattattcaaggaactctttccaaagcttttggagttatgggtggatatattactggatcaaaaaatgtggtagatgttgtcagaagctttgctcctggttttatttttactacagcattatcacctcttattgcatcatctgctagaataagtgttgagcatttaaagaatagttctattgagagagaaaagcaacgtgaggttgttaacaaagtaaaagaatctttttctaaggctggtattgactttgtcaaaacggatacacatataattcctgtaattataggtgattcagtggcttgtacagagatttcacgagtgttacttaaggaatataggatatatatacaatctattaattatcctactgtgcctgtaggtacagagagattaaggattactccaacaccttatcatacagatgaaatgatagataaattaacccaagcgttggttgatgttttgtgtaggtttaaaataatgaataagcaaaattaaaattcttgccaagcgtgaggaatgtgtattaatccttttgaaagtgaaaaaaagtataagtcaaatcttatattgtattcttcaaattttgtatgataagtaatgaaggattttgctgctttaataattgatctttgttgtttattagtaataggaatttctgatccaaatatactggttttaacttctataaaagctaaatatttatttttacaggcaatgatatctatttctcctagaatgcatttatatcgatgttttatgatataatatcctttacattttaaaaaccagattattaatatttctcctaagtaccctacaatgttataaataacgcgcttgtaattcttttttgtaaacatgtatggtgatattgtcagtaaaatcagtttagtatataaagttttttatatagagaaagataattctattatgtttaatgcatttatttgtcttcgcggacatttgtatctatattataaaaagtataatgctttttgattaaggttgggttttgctatatctgcagcctaatgttgtgacagaagtattgtataatagagattaccaatggtgattagtatattaaatttttaatgaagggaaaatggttgtgtatatatcttaatgtttgttacattatgaaaaggtgttttttcttgaataagtgctagaaataacataggcttagtaagtgaatttgatagttttttagtcgtggtttttcttagtgatataaatatagacttttctaaatataggatatgtgctctatcttgtagtggcgtcctcatgcttatttcaatattacttgttttattaaaaggcatatgctttggtacagattttgcaggtggtataataattgaacttcgtgcagatcaagtagatgttaagagtgttaatttaaaactgcaggaaaatggttttgtaggtttttctgttcaaggttttaaaaataatgatagagaactgatggttcgttttaaaaatgaaaaagattcagatcaatcggatactgttgagaaaataaaaggagtgttaaataaaatattgggtgaagtaacttatttaaaaatagattatgttggaccacaagtagggtataaacagatttttgaaggattgtgtgcaataatattttcattattaggaatgtttttgtatttgtgggtaagatttcagtggagatttgcattaggtggtgttttggctctgatacatgatgttgtattaacattggggttggttagtttatgtaatattgaatttaatctttcttcaactgcagcaatcttaacagttatcggttattcagtaaatgattctgtggtaatatatgacaggattagggaattgcttaaaaagaaactgcaaaaaaaactgtctgatgtcattaatatcagtattaacgctactttatcaaggacaatattgacatctggtaccactatgctagcgtctgtccctttaatgttgttatgtcagggtacagttagagaattaagcataattgtattctttggtatagctgttgggacatattcttcaatatttatagcaacaacttctttatctaatgatattaacaaaacctagattttagtagtacagaacaacttttttcctaagtaaaaaagctttttaatgtttagcaaaattgttaggtgtagtatcttgttttgtgactatagaaaaatttgatctgaaatacccgttgtattatgtgtgtgaaaataatgaattttagtatttgaagttttttactatctggttctggtgatggtatatgtaattctttggtgtgtgcttggtggataaactttgttagattttgaattgataaggttttaaagaattatattggttttttagcatagggttccgataggtaagttgtattttatttaaagaaatatactttgagcattttaaaaatcttcaatgataagtaagtttatgaaaacttgttaataaatggaacttatagcgattagtttttgctattggaggctaggaccggaatcgaaccggtatgtaaggatttgcagtcctgcgcatccgccattctgccacctagcctagttatgataaatttttgctatttttcctaccattgatatggcatcattttttggtctttgaaaggaattacgacctataattgatccatctcctccacctaattttattgattgtatttcttgcaataattcttcgtcggtttttgcttctccacctgaaaaaacaaccaatcttcttcctgaaaagcaagataattttatatactctatcctttgttttaaagatgtaatatcataaggtatagaatctctttctatattacttgttggtaatttaacctttataatgtttgctccaagcgatgctgcaatgtgtgcagcataagctactatgtctactgctgtttctccttgttttgaaatatcatttccacgtgggtatgaccatattacaactgctaaacctgctgcttttgcttctgcaattagctctcttgtttctcgaaccatagagaaaaaattgtgggaacctggataaatagtgattcctatagctgaacatcctaaccttagtgcatcttttacagaagaagttaccacttgatcagggaaactgttctttggggaaagcagtgtagagctatttagttttagtataagaggtatcagaccagcgtaagtagatgctccagcttcaagcataccaagtggagctgcgtatgcactaaaccctccttcaatagctaatagaaaatgatagtgtgggtcataagactgaggattctttgaaaaacttttagttggtccatgctccattccttggtctacaggtaatattaacaacttcccactgccagctactttaccgtgtaacagcattctcatcaaatttgcttttactcctgggttctcactttcatagaatcctagaatgtcctgaatacggttgttggctagcacaaagtttctacacattaaacaaatataaataatattagcaaattttttgcctactacaagaaataaaatatgtttacaatagcttacctactactttgataattgagatgttattaataaaaccatgcaagtaagatgttactaaaaatgtttaatagttgattcgttgtatcatgagattaagggtattaatgtgtatattagtaggtgatggagttattgtagaaggagataatttttaaaatttaatgttttgtgattaagaataagatgcctgaaataagtgtttttctgttctttagaagagagcaatgtctataattgaattgacaatgaatgtttaatactgtaatggtttataaaatgattttttgatattaagtaatgccaatagaagtattgatgcctgctctttctccaactatgaaaagtggcactataagaaagtggtataaagcagaaggggatgtagtaaaatcaggtgatgtaatagctgatatagaaactgataaagctgttatggaatgtgagtatacagatgaagatggtatcatgggtaaaattttttttgctgaaggaagcaaaaatatagaggtaaatcaattgatagcattgattgctgtagatgaacaggatttagctaaagttcattcatatgaaaaaggtgataatgttgtaaaaaatgagttagttgcgttacaagatagtcaacctgctcaagatgagtcagttgtattgcaaatgaatcaacaaattgtgaatgctagcgaagtattggttaattcatctaattcttctgaaagagttaaggtgagtcctttagcaaaaaaaattgcttcgaaccttggtgttgatgtaaatttggtaaaaggaacaggcccgtacggtaggattataaaagctgatatattggatgttataaatcagcatggtcacattgctaactctcctgaggatgcttcttttactgaaattagtagtatgcgtagagtaatagcagaacgtttagtgtattcaaaacaaacaattcctcacttttacgtttcaatagattgtcttgtggatagtttgttaaaattaaggttagaaataaatgctgaaaatcctgatactaaggttacagtgaatgatttcatcattaaagctgttgccatgagtattaagaaatttcctgaaattaatgtatcttggtctgatgataagatagttgtatttcctagtattgatatttctgttgctgtatctattgataatggacttatcacaccaattatttttggtgcagataagaaatctttgttagaaatatcaagagaagtgaaagcattagctagtaaggctaaatctggaaaattgaaacctgaagaatttcaaggcggaggttttactgtttctaatcttggtatgtttggtattaaagaattctacgcaattgttaatcctccacagtcttgtataatgtctgttggatgctctgaaaaacgagcaatggttgttaatgagcaaatatgtatttcaaatgttgtgacagtaacattatctgtagaccatagagttattgatggtgtactagcggcaaaatttttaaattgctttaaatcttatctagagaaaccatttttaatgttgatataaacagtttataagtttttcttaaattcatgccccttttttgattggcaaagtctatttctacaataatatttatcttaccttattttttactttgttgtgctgtttattattaatgtgtataggccatagttgttcagtcatattgttcagagaaaaaaatttacagaaatacaggtgtatatgtaagttgggatacattcattatatttgcaattaagtttctcgtaaaaatttgagctgagatttgtaagtaatactttgaaacatatttgggaataagaaagattattgctatgtattgacctagttctgttgagcagattatgaatttgatgtacctgtgggatttgattcagattgcttatcgtacctataaatgattataggattaatgataatgttgttgtgatagagaatacattctgttgttgctatctgcgaatagttctttatgtgttatgaatgatgttagtgtgcaaaagtgccattaataaagaatagtgttgtaggagggctaatttaccttattttttttcaatactatggtgtaaaaaggatgaagcagcaggagtttctgtgatgcaaactggagaagttaagattcctcctcttagtggatgtatagaatctgcagaagtattgaaagttgcagatcttgttgtgggtgcagcaacacttatcaaatttttatagaggttatgcaagaaatccaagaatgatgggccaggatattatattgtgcaagaacaatttagaaaaatattagtttttttaaaggaatacattttaagtatatttgtgatgtttgtacaggaatattttacgtattaccttctgctgtacgggtgtattctacatttaagaccagaaatgctatctattcttcaacagaaagtagagaatagtggcttattgattggaatcttgaatgtgcttgtatttttcattgtacggcaatattatgtgtacctaaattatctcataacttgatatatagtacatctgcgtactctaacccaggagcattaaatacgtgtactgcacggattgttttctgtatgcaaaggggataatctgtacctttaacggataagtggcttattagctaatccttctaatacatcatccatgaagtttggtcgagtacatcatataggattttatcgacaattgtttcagatgttgtgtaatcttatctctcttagatcaagtgatccagaattttcaacagaaatactagatttagcaatggtgagtgtttctatgatgcttagtactatgtgtaataattatagatgtcttctaaatgaatgagatggtgcatccatgaagtttggtagaatacatcatggagggttttatcgacaattgtttcagatgttgtgtaatcttacctctcttagatcgagtgatccaggattttcaacggactagatttagcaatagtaagtgtttttgtgatctttggtactacgtgtaataattatagatgtcttctaaatgaacagatggtacatcagatacaagaaatttgtgtgtaatgatgtggaagtatacgaaatcgcaaaggatattatgccaggaggttagcagtgtcatattctattatctaactttctatatatgtattctataaatgatgatggagtaatatgtgtagatagtataccattgccacgtatcacattagaaagatgtgatgaaaattttgctgctagggttcagcaaagtatagtcgataatagtatgaattttagtgttcttatagaagatttagcttcacgtgttgttcataatataatatgtctagtgtagctgcttgtgaggaagccatagaagcatattgtgcgttgtatgatgaagtaatatgctctgtgaaaaagatcaagctagaggattataaactgaattgctactctatattttagggatttagtatcaataaatcttattggaattcagaaatgaatagtgttttaaaatactcaaagttgttttggttatggctatattactgtaatttttatatgtctttgacgaagataagatagaataagtagacttatgattgtagtagtgtaaagctgtgatttcttaatagataggaattatagtttccctaatatagtttatatgtaaagtaatatgttaaaaaaattagttaaactatgagttgtattagtgttatacttgtgtttattacgagttttataatatattgtgtttgaactatttattgttattacttctattgttggtggtgctacagcattatttggtttaatggctggttctgataaagtggtaaaaaagaacaagaggaagagcagaaggcaaggcctaatagaagaaggacacgacaagctgagaaatcaagccaagaacaagctaaagagcaagatgtaggagcttcatctgacacaaaggtagaagaaaaaaaagatatacaacatgggtctgatgatggtcaagagaaagctaagggggtggggggagtagatggagcgtctggattgcaacatgtacctggtacatatgaatctagtcagttaaagcctgaaactggtgatagtgatacactatcatctgagttacaagatcaatatttacgtcagggtgcaaagccaaaaaaacgtgctcagggctctatgcgtcaggcaacggttcctgtagtatctactactgaggaagtagaaactcagtcttcaaaaaaagataaatatcgtgtaagagtaccttatcgtgtaagagtaccttttattcctaggtttgcgcgacttgaagaagaacagcaacatctacaatctcaacagtctgatgctggaactagtgaaagtgtagtaagaaaaagagaagcttgtgaaccagagaaaaaacatgttgctaaggttaagccatcaaagcctagtaccaaaccttttattcctaggtttgcgcgacttgaagaagaacagcaacatctacaatctcaacagtctgatgctggaactagtgaaagtgtagtaagaaaaagagaagcttgtgaaccagagaaaaaacatgttgctaaggttaagccatcaaagcctagtaccaaaccttttattcctaggtttgcgcgacttgaagaagaacagcaacgtctacaatctcaacagtctgatgctggaactagtgaaagtgtagtaagaaaaagagaagcttgtgaaccagagaaaaaacatgttgctaaggttaagccatcaaagcctagtaccaaaccttttattcctaggtttgcgcgacttgaagaagaacagcaacgtctacaatctcaacagtctgatgctggaactgataaagattcactacaaagagcagaggctttaacaatgcgagagcctggttttcctaaaatgtatacaccgcaatatcctgtgagaatattgcaacgtgtacagcataaaaaagatgacgctgttgtaagtaagggtgtagttgaaggtagtgcaggtgatgttgagcaaggatttgcaaggttgcaaattcaaggtgatgaagcttcaggtgctgtagaggtaggaggtagtcaagttagtacgggtctcgaaagtgtgttagtatctaaaggctcaagtgtttttaatgtagcgtattttccgaagtttggtagggggagtaaatcaaaaaggttatctggtcgaaaatatcgtgtgttacaagaagaatatagattacagctctgggattttacagatatgcatttacaacatgctcgctttatagttagaaaaatgttttgtttggagtgtggtgttgtacgtctaaagaaagatctactatcttttataggcaatagaatagaaaatcctgaattctgcattcttatttttaaagttgcttgccttgggcattgtatgtcagtgaccaatattattaaattctatcatagcttattctataacgagatagatgatcaagtattagaagaatgtgtgcaagatatcgttatatatgcacaagatacagagctatctattactaaaatagctggtgtgttttctaatagttatactagctatgtttcaaaaaatactgtgccccatccgcctggtttttatcgtcatgtgttacgattgttgtgtaatcttgtttctgctagagttagtgatccagaatgtccagttgatgtattagactgtgtgatagtgtgtgctgcacaactgttgggtactgtgtataataattataaaagttttacaaaaatgcaaggcgtgaatatagataacatgagctttttttcagtagtagaaaatatgggatcaacaagacattgttgtggacagcttggactagtgtgttatggtcttttgaattgtatgacatatatgtatagtgtaaatgataatggtgtgaaaaatgtgggtggtcttgctatgccgaaaatagttgtggaacggtgttctgaacatttttatggtgtggttgaaaggaatatggcttctggtaatatgggatttcatgttattatgggagattgtgctgcacgtgtttgtgcggcagtggatagatataatgtaatggcttgtgaagatgagatagcaggatatgagggcatatataatcaggtaatgcgtagttctaaagaggagaaagggccacaaaggtaaaactccatttgtttttatttggttgtacagtcaataaagcatgtattagggttgtatattagatcttaataggatcataaaagtaataattaatgtaagtgagtttttgtagaaaataccgttattcatgtatgcatttaattttaatatgttttaaagttactgtttgtaagaattcaggcaataaagcatgtgtgaaagttgtggattagatcttaatataaatcataaaagtgatgactatgtaaataagtttttgtagaaaatgcttttataattttcattgtgttattcatttgtgcgtttgatcgtaatatattttagaatgactgtttgtaagaattcaggcaataaagcatgtgtgaaagttgtgggttagatcttaatataaatcataaaagtgatgactatgtaaataagtttttatagaaaatacttttataatttttattgtgttattcatttgtgtgtttgatcgtaatatgttttaagattgctgtttttaagaattcaggggattttttgtaaattcctgtaattggtgaattagaatagtgttatttcattttattaggtagttcctgttgcatcataattggtgtaaaaagcgctattgtttcttgtaaaaagtgttaaaatatgataatatattgataaaaatttaataaattctttttccaatcatatagattaagtgtgttattatgttattctctatagttgctgttgttactgcagctgctattgctgtagtcatgatgatgagtggtgatgaaattaaaaaagcagcatcgaagtcatctggtaaaaaaggaagggcaaaaagtagtaagacaagtagtcaggtacagaagagtctagaaccagtaactagtgctggtgagcaggctcctactgttcaacaggaagaaatagtacaactgccctctgattctcaatttgagtcttctaatcaagacattgtgcaaacggaggagcaggttgttaagaaaaaagaagacgtaaagtctggggatcaatctcagaaaaaagctgttaaaaagaagttagtgttaagagacttttatagtggctttaaaggttctagtgaaaaagttcaagttgatattactggtggaccaattactggtcagcctactatgttaagttatgctgaaagagctaggattgggatatctagtaaagaaaaggggaaagctgttggtcaacctattacattaagttgttctgaaaaagctagtagtagtgtaaaggggaaaaaaggtcctcatgcggttagtcaagagggatatgttgttcagaagggagatccggggagtaagtatttaggggaggaggtaaagccaaaagtttctggtattcaacctataaaagtaaaagaagagagtaaatctagttctatatcagagagtgtggtaaaactgtcagatcaaccttcaagaaaatccctaaagaaattagtattgggagactccaaggcaggtagtgttcctggtgtgttaaaaagccctattgaaggggatactgttgctcgaccttctttaagctatgctgaaaaagttagaattgggatatctagtaaagaaaaggaggcagctgttagtcaacctactgaattaatttgttctgaaaaagctagtagtggtgtaaaggagaaaaaaagtcctcatacggttagtcaggagggaagtcaagagggatatgttgttcagaaggaagatctagaaagtaagtatttaagggaaggggcaaagccaaaagtttctggtattcagcctttaaaagtacaagaagagattaaatctagttctatatcagaaagtgtagtaaaaccatcagatcaaccttcaaggaaacccctaaagaaaatagtattggaagacactaagacaggtagtgttcctggtgtgttaaaaagccctactgaaggggatactgttgctcgaccttctttaagctatgctgaaaaagttagaattgggatatctagtaaagaaaaggaggcagctgttgctcgatctgctgtattaagttatgctgaaaaaggtaaagttggaatatctagtgaaaagaagcagtcaaaagatcctgatgatgttattgttcttagtactagtggtaaatcagtaaatgatgacttacaacctgttcctcaagtattaattccagtgcaggttgtgcctgctcagcacattgttagtcgtcctgttatttacaaacatttgtcatatggttctaaagctggctatagtcttgctatacagcaatttagagaagagaaaatatgggattttgcaaaaatgcatatggcatatgttcatgactcactaaattatatgttttttgtgaaaaatggaaagcttttactaaagcctgaaattcgagatcttctattaaaaataactaacaatatagatctatgtacctttttaatgaaaatggtaatgctagatcatctgatgagtagactttgtaagttttatgttagtgatagcctgaagtactgtgcaagtcattttcgtaatccaagtcttgtagataacttacttattcagattttgagtaaaaaacgtattgactgtataacaatgtcacaagaactgcgatataatcttgctatgtgtactaaaggttatgacgctgaagtttttgagctacatgatagtattttttacagtgaagtgttaagcctatactgtgaatttatgcatgcatcagttgatgatgaacaatctaaaactttgtgtagtttggtagagttatcttgtgctttacagtttggacaaatgtatcatgtacttggtaagtctaaacatatggttgttgagggtatgaatatagagaaaatggaaaaagacttgtctgaaggaaaagatgtaaaacagtttatttttcgtgctagaatttttggtggctactgttatgcaatgcgaaaagcattaagacatatgtatattccaactgataaaaatactgcgtgtgcggtagctggattaaatgttccatctagaatgttgaaagtatgtagtaaggacattgctgagatcattgatgatcatgttaaaagaaataaaatggactttagtgtttttgttaataatatggtaagttctgtaaagagattcatggtgaatcgacatacaaggtttctagtacgagaagacatttcaatatatcaggcaaaaataagtagtaaatataaaacaataggacctgatagccaggtttgttcattataggtttacagactttatatatgttaacaatattttaaaggtgtgtgataagtaatataagcatgtgagagatttttgtacttattgttgaataagtgttgaaattgttgtttgttttagactttaaaaaaatttttaaagttagggcagtatattattaagtagctctccatatgtctagtagtaattattgtattcttgtgaaaatattgagaatataataatgttaattatgaagaatttaattttttaaactttcattatcaagtaagtgtgttgttatgataattcctgtggttactactgttgctgcagctgttgttgttgtgataacgttaatgaatggtgtaggactgcaaaaggagcgtcaaaatcatcttagaagtctggtaaatcgaagaataaaaaggcaagtgagagtgaaaaggcattggttgatgtaaatgggcaagatgtttctgagaaagaagaaaaatctagttttgtatcagaagatatagaaaaactatcgggccgctctttaagaagacctcttgaaaaaagttagtgttaaaaagtctcaagagttaatatactcttggtacattgggaagtcgtgatgtagatggtgtacataatgttggttatgcgaaaaaagaagaggctacttataactctgaactaactgttgttcacacaaaaaatttagaaggttaatatttaaaagagtgtgcaaggtcaaaagtgcatggaagtcaagctgtagggatagaaaacagagtgtaatgttactaaggaaaaaagaagaaaagaagcctacttctgtacggaagatatactgaaatcactattcacaagagtctgaaggtgagttagcattaaaaggcctcaaggttagaccattagaagatcataagacgagtttgggtgatattggttatgtaaggaaaaagaaagatttttgtgttgcaagttctggacgagttgttactcaagcagaaagttgagaaagtagatatttaagggaggtgtaaagccaaaggtttctggtactagaacttgtttcaaacaagagtaggtagtgctaaaaaaactaacatagaagtatctgtttctagaaaggcttgaaaagaaggaagcgaagtaggaaaaagtatttgatgttgcttcttctattcctgttggtgatattgtaaaaactggtttggttgttcaaccaatagctaataaagatttcaaaagaaatttgagtaaaaaggatgatcttgtagccaaaaatatgcttcgaatgtgtagtaaaacaattaggaagaaaatacaatattgtatcgacgcactatggttttactgtttttttgatgatatactacgttatgtaatgaggttgctatcaagtccaacgacaagatttctttttaaaaaaagacccaaaatatatcgtaatctgatagatgacaaaatactattagaccaaatgtaccttttcctataccataaattttaatgtattgttggttttggatgttagtacttaaaatgtatctaacatgttattaactgtatatatttatcaatatcctataaagtgtaaaaactgtaggtaataattctgtacattattactaattgcataattttgatacatttcaatattactgcttacttagcaagtttattatgactttcttcatattttaaaaaccagaaagtagggctatattattaattatttatataattagtaaaaaagtttaatttcttgatgaaatgttgaagatatattaatattattataaattaaattaaatatttcttaaaatatgtattaataaataaaaggtactttctatgataattcctgtggttgctgcagctgcggctgttgttgctatgataaggttgatgaataatggtgaaaagagaaagttatcgaaatcatctggtaaatacaataagcagagagaattaagaagtagaaagacatatcagttaaagcaagtgaggacggggatagtagttggtgtaaatgagcaggatattgctggtgaagagcaggagatgccgttgtcacagcaattccctaatttgcatcctgaatcttgtcaagatattataaaggcagaagatcgtagagtgggtgttgttactaaaaaaaagaagaggaaatctagtcctgtatcaaaggatatgataagatcatcggatcaactttcaacaggaactttaaaagaatctgatgagtacggtaaaaaaaggaaatcaaaaaatagaaaaacaggtagtccgttaaaacaagtaaagacggtaatagtagttggtacaaataagcaggatattgctagtgaggagcaggagatgccattgtcacagcaactctctgatttgcatcctgaatcttgtgatcaagatattgtaaaggcagaagatcgtagagtatgtgttgctactaaagagaagaggaggaaatctagtcctatatcaaaggatatgataggatcatcggatcaactttcaataggaactttaaaagaatctgatgagtacggtaaaaaaaggaaatcaaaaaatagaaaaacaggtagtccgttaaaacaagtgaagacgggaatagtagctagtgcaaatgagcaggatattgctggtgaagggcagggaataccgttatcacatcaactcctgcactttgaatcttgtgatcaaaatattgtaaaggtagaagatcggaaagtacatgttgttactagagaagaaagaaaatctaatccagtattagaagataatgaatatttaaaacaggatgcaaagtcaaaagttcatgcaggacaagctgttggacaaccaatgagttgtgctgaaaaggctaaagctaaggtatcttctgttgaagagactgtaggaaaagtatgtactgatcagaaagttaaagaagtctctgaatgtaaaaatgatgtttatgatactagcgtacaacatactgcagtaagttatgttgaaaaggttaaggttggtttatctgatgatctaggaaagacacttcttcctatagatttgaaaagaactgtgagtcaacaagatttgaatagtgaatatttaaaacaaagtgcaaagtcaaaagttcatgcaggacaagctgttggacaaccaatgagttatgctgaaaaggctaaggtatcttctgttaaagaagctgtgggaaaagcatgcactggccagaaagttaaaggagcctctggatttaaaaatgatgttgatgaaacattgagtgctagtatgcaacatactgcagtacctggaatggtaactccaacaaatattattcctgctaggcatattgtaagtggagtagctgttttcaaacatttgcagggttattcgttagaagaataccaatctttagtggaaaattttaggaaatctgtagcgtgcttttcaaagatgcatatgtcctatgcgtatcaaatattgcataatacattcattgtacacaatggacagattgtgttgaaacctgaaattgaacagtttctattgaaaacaaccagtaatataaaactgtgtacctttataattaaaataggaatagtagaccaagttatggctaggcttggcaattcttatggttgtaatagcataaaatattgtgcaagctattaccatgattcagaaattatagatgaaattcttattaggttttatggtacatcatattctagtttttcagaggtgtcacaacaagtacgtcatgatacagttgattgtcttaagaaacgtaatgtgacaaatgtttttaagctacatgatagtagcttttattcagaagtattaagtgtgtgttgtaactttatgggtgtaagtaataaagacatagaattgcacaaactatgtagttttgttcagttatcttgttgtatacaaattgcgcaaatgtatcacatgatgctaaaggtaaaatattctgctggagacaagcaagattatgcacaacaatgtatatctgaaagacttgcaaaaggacctgcaataaaggattttatgtatcgtgctttactttttggtagatgtgcttgtaatgtaaggaacacatttaggcatttatatagtccagatgataaaaatcatatacgtacagtatctgggttaaacgttccgtattgtatgattcgagtaagtagtaagggaattattccaaaaattgagagttatattaagagaaataaaatggattttggtgtttttgttgatgatatagtaaattttgtcagagatgcattgtatcgtccaggtgaaagaacttgtatcaaagaagacataaaaacatatcacactatagtaagtagtcgatatgacaatatgataagtaattgtagcgtttccagatgagaagaagtttgtgtaaaagaggacaaagaacatatactctatgataagtagccgatatacaacatgataagtaattgtggtatctccgggtgaaggggtttgtgtagaagagaagacaaaggacattaccctatagtaagtaaccgatatgcaaatgataggtaattgcggtgtctccggtgaagaggtttgtgtacaataagtagctaatatagaacctgaatctccttctttttatttattgtagatttaaatgtgtttcattttgaatgttgtttaagtcatgtgtaggattgtgtgtattatcaatgttctaagatacattaggtaataattgctgaatatattcaattacttgttattttaaggattttctatgtttggagatttagaaggtaagactttattgttattgtcttgttgagtatatatcttaaatgttgtggtcaatggaaaaaaggttgtaatttcttgctaacatattgaaaatatattagaattatttatgaagatttaaatcttttttgatttcattacatcgaataagtgtgtttttatgctaatttctgtagttactgcggttgttattcctatagtaataatgttaatgggtgataatgaagctgcaaaagagtcacctcgtaaaaagaaaaagtcaaaaaataaaaaaacaggtagtccgttaaaacaagtagaaactagaacaataactattgaaagcaagcagagtgttgatactgaagaacgaacgggactgttatcagagcaactttctagtatgcaccttgaatcttgtgatcaggatattgtaaaagcgaaaggtcaggatgtacaacatcttactgaaaaaaaagacggggaaacatctcatgttttattgggaggtacaatcaaaccacgtagtcgacgctctgggaaattaacattaagaaatgtggggagtgctagttttactactcaatcggtaagtgatgctgcaaaggttagtggtgcatctaatgttggtcatgtagaaggtgcttcttgtattccagaccagggcagcgccactgtaggcgtgcaaagtttagaaagtaagtatttaaaagaaggtgcaaagccaaaagttcgtgtaggacaaattgttgaacaatcagtgagttatgctaaaaaagctagtactggaatacctattgttaaaaaagatgtgaaagaagggggggggggggaggagtgttagtcaagaaactactgttgtagttcctgttggtagtgttacaaaagctggttcaactgtttgcccagtaagtgatgctgagaaatctgtaactaagagatctcctgttaaagagagtataggaaaagcatgtactggccagaaaattgaagaagcctctgggttaaaagatgaagttgataaaacattaagtgctagtatgcaacatgctgcagtacctggagtggtagcttcagcaaacgttattcctgctaagcatcttgtaattagaggaaaggttttcaaacatgtgaagcgttattcgatagaggaatataaatctcaaataaaagagtttagggaatctatagcgtgttttgcaagaatgcatatgtcctatatgtatcatatgctgcataatacgtttgttgtaaacaatggaaggattatgtttaagcctgaagttgaacagtttctattaggaataaccagtaatatgaagctgtgtacttttgtgattaagataggaatagtagagcatgttatgagtaggatttgcaggttttatggttctgacagcataaagtattgtgcgagtcattaccgtgatccaaagttcatagattcgatacttgttatactgcatgatgcatcacattttgatttttcaacgatgtcatatcaagtacgcaacagtatggctaattgtgttaggcgatataacattacaagtgtttatgagctacatgatagtagtttttactcagaattattaagtatgtgttatgattttgttcgtgcaaagagtaatcagagtgtacaatttcaagaattatgtgattttataaagttgtcttctactgtgcaacttgcgcaaatgtatcacatgatactaaaaaccaaatgttctactggaaatgaacaagataatctgcaaggacttttattacaagaacgtaatatagagagtctgatatatagttctgtattttttggtaagtatgcttgtcgtgtaagaaaagcgtttaggcatttatatgctccaagtgataaaaaccctgtacgtacagtatctgggttaaacattccatatgttatgattcaactgaatagtaagggaatttttgcagaaattgaacattgtgtaaacgcagaaaaaatggattttaatgtttttgttcgtgatatagtgcgttatatcaacaagctattatcgtatccacgtgaagaaggttatataagagcagatataggtaaatattgcgctatggtaagtagtcgatatagtactatgggagctgacatagttccttcttctcttcattgattgtagatttaaatgtgtttcattttgaatgttgtttaagtcatgtgtaggtattgtgtgtattatcaatgttctataaggtgcattagggaataattactgaatatattcaattacttgttattttaaggattttctatatttggagatttagaaggtaagactttattgttattgtcttgttgagtatatatcttaaatgttgtggtcaatggaaaaaaggttgtaatttcttgctaacatattgaaaatatattagaattatttatgaagatttaaatcttttttgatttcattacatcgaataagtgtgtttttatgctaatttctgtagttactgcggttgttattcctatagtaataatgttaatgggtgataatgaagctgcaaaagagtcacctcgtaaaaagaaaaagtcgaaaaataaaaaaacaggtagtccgttaaaacaagtagaaactagaacaataactattgaaagcaagcagagtgttgatactgaagaacgaacgggactgttatcagagcaactttctaatgtgcaccttgaatcttgtgatcaggatattgtaaaagcgaaaggtcaggatgtacaacatcttactgaaaaaaaagacggggaaacatctcatgttttattgggaggtacaatcaaaccacgtagtcgacgctctgggaaattaacattaagaaatatggggagtgctagttttactactcaatcggtaagtgatgctgcaaaggttagtggtgcatctaatgttggtcatgtagaaggtgcttcttgtattccagaccagagcagcgctactgtaggcatgcaaagtttagaaagtaagtatttaaaagaaggtgcaaagccaaaagttcgtgtaggacgaactgttgagcaatcagtgagttatgctaaaaaagctagtactggaatacctattgttaaaaaagatgtgaaagaagggggggggggggagtgttagtcaagaaactactgttgtagttcctgttggtagtgttacaaaagctggtccgactgtttgcccagtaagtgatgctgagaaatctgtaactaagagatctcctgttaaagagagtataggaaaagcatgtactggccagaaaattgaagaagcctctgggttaaaagatgaagttgatgaaacattaagtgttggtatgcaacatactgcagtacctgaaatggtagctccaacaagcattattcctgctaagcatcttgtaattcagggaaggtttacaaacatgtgaagcgttattcgatagaggaatataaatctcaagtacacgagttcagggaatctataatgtgttttgcaaaaatgcatatgtcctatatacgtcgtatactgcatggtacgttcgttgtaaacaatggaaagattatgttgaagcctgaaattgaacagtgtctattaggaataaccagtaatatgaagctgtgtacctttgtgattaagataggaatagtagagcatgttatgagtaggatttgcagaatgtatggttctgacagcataaagtattgtgcaagtcattaccgtgatccaaagttcatagattcgatacttgttatactgcatgatgcatcacattttgatttttcaacgatgtcatatcaagtacgcaacagtatggctaattgtgttagggaatataagattacaaatgtttatgagctacatgatagtagtttttactcagaattattaagtatgtattatgattttgttcgtgcaaagagtaatcagagtgtacaatttcaagaattatgtgattttataaagttgtcttctactgtgcaacttgcgcaaatgtatcacatgatactaaaaaccaaatgttctactggaaatgaacaagataatctgcaagaacttttattacaagaacgtggtatagggcatctgatatatagttctgtattttttggtaagtatgcttgtcgtgtaagaaatgcatttaggcatttgtatagtccagatgataaaaaccctatacatacaatatctgggttaaacgttccgtattgtgtaattcgaataagtagtaggaaaattattccaaaagttgagagttgtatcaaggcaaataaaatggattttagtgtttttgttgatgatatagtacattttgtcaaagatacattgtatcgtccaggtgaagaggttcgtgtaagaaaagatataagtacatattgcactatagtaagtaatcgatatagtactatgggagctgacatagcttcttcttctcttcattgattgtagatttaaatgtgtttcattttgaatgttgtttaagtcatgtgtaggattgtgtgtattatcaatgttctataaggtgcattagggaataattactgaatatattcaattacttgttattttaaggattttctatatttggagatttagaaggtaagactttattgttattgtcttgttgagtatatatcttaaatgttgtggtcaatggaaaaaaggttgtaatttcttgctaacatattgaaaatatagtaatattatttatagagaatttaaatcttttttaatttgcattacatcgaataagtgtgtctttatgctaatttctgtagttgctgcggttgttattcctgcagtaacattaatgttaatgagtggtgatgaagctgcaaaagagtcacctcgtaaaaagaaaaagtcgaaaaataaaaaaacaggtagtccattaaaacaagtagaaactagaacaataactattgaaagcaagcagagtattgatactgaagaacgaacgggactgttatcagagcaactttctagtatgcaccttgaatcttgtgatcaggatattgtaaaagcgaaaggtcaggatgtacaacatctgactgaaaaaaaagacgggggaatatctcatgttttattgggaggtacaatcaaaccacgtagtcgacgctctgggaaattaacattaagaaatatggggagtgctagttttactactcaatcagtaagttatgctgcaaaggttagtggtacatataatgttggtcatgtagaaggtgcttcttgtatgctagatcgtgaaagcactactgtagacacacaaaatttggaaagtaagtatttaaaagaaggtgcaaagccaaaagttcgtgtaggacaaactgttgaacaatcagtgagttatgctaaaaaagctagtactggaatacctattgttaaaaaagatgtgaaagaaggggggggggggagaggaatgttagtcaagaaaaaactactgttgtaattcctgttggtaatgttacaaaagctggttcaactgtttacccagtaagttatgctgaaaaagctagaactaagatatcttctgttaaagagggtgtagaaaaagcatgcactggccagaaaattgaagaagcctctgggttaaaagatgaagttgataaaacattaagtgctagtatgcaacatactgcagtacctggaatggtagctccaacaagcgttatttctgctaagcatgttgtaattaaaggacttgtttacaagcatgtgaagcattattcgatagaggaatataaatctcaaataaaagagtttagggaatctataacgtgttttgcaagaatgcatatgtcctatatgtatcatatgctgcataatacgttcgttgtaaggaatggaaggattatgttgaagtctgaaattgaacagtgtctatcaaaaataaccagtaatataaggctgtgtgcctttgtgattaagataggaatagtagaccacgttatgagtaggctttgcaggttttatggttctgacagcataaagtattgtgcaagtcattaccatgatccaagggttatagattcgatacttattgggttatatggtgcgtcatattctgatttttcaaggatgtcatatcaagtacgtagtaatatagtttattgtgttggaaaacatggtattgcaggtgtttttaagctacataatagtggtttttactcagaattattaggtatgtgttatgattttgttcatgcaaggggtaagggtgtaaaattgcaagaattatgtgattttatgaagttgtcttgtagtatacaacttgggcaaatgtatcacatgatggtaaaagtcaaatgttctattggagatgagcaaagtgatatacggaaacttgtatcccaagaatgtagtgtagggtatctagtatatcgttctttactttttggtaggtatgcttatcatgtaagaaaagcgtttaggcatttatatgctccaagtgataaaaaccctgtacgtacagtatctgggttaaacattccgcatagtctaattcgactaaatcatagaggaatttttacaaaaattgaacattgtataaacgcagaaaaaatgagttttaatgtttttgttgttgatatagtgcgtcatattgacaagctattattgcatccgcgtgaagaagtttatataagagaagatataagtacatattgcgctatagtgagtagtagatatagtactatggggcctgacatagattcttcttatcatatattgtagatttgaatgttatcttaaattatgttttaggtattgtgttgtattgtcaatgttctataaagtacgtttaatcaatggttgctggtaacgtaatctttatgcgtttcagaatgatatagtaaagagcattttaatagtttttctgtagttggataatcaagacagtaagattgtgttactgttgttttattaagtagaatcttatattgatcagtttaggtatagtacatttctttatgcactgtaaaggtgcttttagatttttaagtattcattaatagtgatatatgatatctaacgttaacatattgtgaaatggataaacttgaaaatattttaataaccttaggtaagaattctctatcttatatttaagttattagaagctaatagatttttatcttctgctgtgagaaatgaatattgggggttttaaccacagtttgttaaattgcttagtaggcaatcagataaaaacttattctaaaatttttgccaaatgtaagcagtatatatttgtgctataagcattataaaagttaaagatttacaatgcttatagaaactgactatcaataatattgcattattactgggggttaatatctataagatattggtatttatatattgaattttatgggaatatatgtttattgctcagatgtgagcataattttttgcatgtgtggcatcataatttctatgaaattcttcactaattcttcctgctgattttgtgataatgttttttgatctgcattaagtgcagaagtaattaaaggtgttagtaccttgtttaactctggaattgctgacttcacttcattttttatacatgctttcatttttggatctattgttgtattacaccctttttcaacatagctcatagcgttatctaaacttttatctagcgataattcttcattcatgatggttgtacctaaaattattactgatttaaattttattatatatttattaataaaatcataattcttgttgagagttgatttttttggtatagtcattacatttgatacggttcttgaaagtctgtgttattgttcttaagattagaatgctcaatgtaagatcgataatgttttgagtttgttgaaaaatactccgcattatttgtgtaatgaattgtaagtttattatagttaatgataacacaattaagtactattttataggttgtagtctttacaaagctactatagttgtagttctgatgttaatagtggatattatcaaaacaaatgatggacttttattttgtacagttataaaggtaatataaatgtcaagggtggcaattattgattttggttcgcaatttacacaattgcttgctagaaggataagagaactaaatgtttattctgaaatttttccgcatgatatagcatttgattacataaaagatagtaaagcatttattttatctggaggtcctaagtcggttctggattttacaggaatgcctccaatagttcacgatattattgaattgaataaaaaaacttccgttccagtattgggagtgtgttatggattacaacttttaagtaattattttaactcgacaattgtacatgggtgtggtcaggaatttgggaaagctattctaaatgttgtcaaaaaatcagaaatgataaaagatgtgtggaaagtaggagaccaaccctatgtgtggatgagtcatgcagatagtgtatatgatactccatgcggatttgaagtcatagcatgtagtgtagtgaataatgcaattgcgatgatcagcaatgaggaaagaagaatttatggtgtacaatttcatcctgaagtatatcacactccggatggggtaaaattacttgctaattttgtcagaatagcaggttgtgacaataactggacagtggaatcctttttagatgagcaagagaatcttataaagaaacaagtgggagataaaaaagtaattgctgctcttagtggtggtgttgattctagtgttgctgcagctttgacttatcgagcaataggtgatcaattacactgtatctttattgataatggcttactgcgctataatgaagcagaaaaagtaagacaatcgtttgttgatcagtttcaaatgcctgtaactattgttgatagatcatcagtatttttagataaacttcaatttgttactgatccagagcaaaagcgaaaaataataggaaaaacgtttattgaagtatttgaagaagaagcgaataagatagggaacgtagaatttttaatgcaaggtactatataccctgatgttatagaatctggtggctctgttgggaaagaaagtgttactatcaaatcacatcataatgttggtggactacctgatataatgaagttacagcttgttgaaccactaaagcttttgtttaaagatgaagtgagattgttggggaaaaaacttggtatatcagatgaaatattaatgcgtcatccattcccaggacctggtttagcaattagaataataggtgaaattactcaagagaaggttaatatgttgcaggctgccgatgagatatatattaatcttatcaaaaaatataatttgtacgatgttatatggcaagcgtttgcagtgctattgccagtgaaaacagtgggtgtaatgggtgatagtagaacttatggttatacttgtgctttaagagcagttacttctagtgatggtatgactgcagaatgtttcccatttggtgtagacttggaaactaagataatcttttatgagtttctacaggatgttagtaatactattgtgaataatgttcaaggaattaatagagtggtatatgatactacatctaaacctccagctacaattgaatgggaatagatattgaacacttataagttggagtgttattatttgattaatgtgtcatagagtttgattgagtcattttatgagtatttaagttttacaaggaaaatttgaatagcttagtaaaactgataaatttaagtttgtgccgctaataatgttataaatttgtagtattatgattttaggcttatacagttatagagatttaaactttattagtttttaacaatcgacatatttaataagtttaatataatgtgactatctgttaataattaatgttaaatttttatttttaaatatgtatcaaataggaaaaaatatattaactaacaactttgagaaatataaaaaaatatagtagaaattgtggttactggttatagtatacaaaaagtagaattatgacttaattgatattataggtttataaaaatttatatatgaataagtgatttgttttacgaaaagttaaaaattagtattgataatgttatgtaaaattttgtgtgtgaatgcctttaaaaaacataaaattttgagtgcaatatacacgggattacattacttctgataagatttgaagtgtttggtttcttatttttatctgtttatgttatataagcaagatatgtgtggggttattattaatttgggtaggattatggttaaagaagcagtattagaattggatggtcaaagaataaaattgccggtgttatatgatactcatgggaataaggctgtagatattacttctttatataaaaatacaggaatattaacttatgatccaggatttatgtctactgctgcttgtgaatctaggattacatttattgatgggaataaaggtatattatgttataggggacatgatatagtaaatttagtaaataataataaaagttttatagaaatagtgtatttgttattttatggtgttctccctggtcttgaggatttgcaaaattttatatcgcaaatttctcaggaatataaccctcctaagatagttcatgatgttataaaatcattcccacgagattcacatcctatgtctatattaatggcatgtttttctgcgttagcatcatgttatcataatcaggataatagtgcagatcaattaaagtgtgctaagttagcagttgctaaagttgcaagtataatagcactgatttatagatatataaccaatcaagattttgtcgaatctgatacaaagttatcttacagtgaaaattttgtacatatgatgtttgatatttcttcttataagttcactcaagttgttgctaaggctttggatattatttttgtattacatgctgatcatgaacagaatgcttctactgctactgttagattatctggttcttcaggtgcagatttatttgcttgtttagtggcgggaacagcgactttgtgggggccagctcatggtggagcaaatgaagctgtgattaatatgttaatggcaattgaaaagccaagtaatgtaaagcaatttattcaaaaggtaaaagatggtaacaagagtactagacttatggggtttggtcatagagtatataagaattatgacccacgtgctaaaataatgtataaaatttgtagagaagtattaaataatttaaatgtgaatgatccattattagaaatagcattagagttagaaaatatagcattacaagatagttattttattgatcgtaatttgtatcctaatgtagatttttattccggaattgttttaaaagctattggaatcccggttaggatgtttactacattatttgcattagctagaacgtctggttggtctgctcaatggtatgagatggtagcagaagaaaattataaaatatgtcgtccacgtcagttgtatactggtaatattgcagaatgttaacataattttgaattatcattgcttattgttttaatattattgataattatgcgcatattaattgtggatttgtatatgtatatcttgttaaccataaaaattatttagaagtgtatataattagaaatatgtgttaatatatgagggtaatcttaggatataaacatagatataagttaaaaatgaagttatatactgtagttgtaatattacgttaagtaaaaattttttatgcttaactatggataattatcttaaagtgttgatgtcctatgagtttactcgcaatgttttattggtactaatgacggtaattattgatacattaaatgatatattaacaaaatataagttagatatagagaattggttttttaataaatttactaagtataacccggttttgaatatttcggttgatttaagagtatctgattataagattgctccggtagatactaatatttttcctgcaggctataataattttactgagcaatcccaaatttatgcttctcgattgttaagggaatatgtagttaattatgcgaactgtagcaaaattttaattatagcagagaatcatacaagaaatttaaaatatattgatagtttgattgttttaaaaaatatagttaataatgcaggttttgttgttgaagtagggatatgtaatataaatcaaaatatagaactgatttcatcaacaggacgtgtgataaattgtttatgtcttactaatgataatggtgtacttcgtgctggatgtaggtttattcctgatcttattttagtcaataatgatatgactagtgggattcctgaagtactacaaggtttaaaatatcaaagtattatgccatctttatttttgggatggtttaatagaagtaaatctaatcatttttctatttataaaaagttatccaaagagttttgtgagagttttaatattgatccttggttaatttcagcatttttctctagttgtagtaatatttgttttttcaacagtcaaggaattgatgatattgctaatgaagtggatgtagttattagcaaaatacgtaataaattccaattatatagtattaaggaacagccatatgtgtttgtgaaagctgataatggaacttatggtatgggaatattagtagcttattgtggagatgatatcttaatgcttaataggaaaaagcgtaataaaatgaaaaagattaaagatggtaatgttgtcagtagtgtaataatacaggaaggtattactactagagagatctttaatggttatgtagctgagccattagtttattttatagggcatactccttcatgttacttatacaggtatcattctgtaaaggatagattttctaatttaaattctgtaggctgtgactttatagatataagttataaacagcaagacatattgtattggaatataattggaaaaatagctgttttagctgctgcaattgagatgcatgagatatcaaatgttaatgtaatggagcaaaattgcttactaagttaaattgctaatcttatgtgttgtttttgacaatattattatacaaaagttggtaaatatatctgttgattaacataggatctataatgtgttattacagtatagtcataaatatgggatccctgtatcttttctgataatgtaaagcaagtgagcatccaaatactttatgtgctattgaaggtagtataagctcataatattacatcaaggttttatagtcatatctgttgattaacatagaatctataatgtgttattacagtgtagtcataagtatgggatccctgtatcttttctgataatgtaaagcaagtgagcatccaaatactttatgtgctgttgaagggagtatactcatatattacatcaaagttttatagtctttgtacacagggttttgtacaatgttattaatactgaagatcttagttaattacttcctagtaatcattgttgtgaggtaatacttaaatattacttcttggtttgaatctgattttttgcactgtatttctatctctactagtttttttattatgttgttgatttcggcatatgggattgcagatacatgtttttttattgtaggaattgatttgaaaaatataggaggatgtatagattttattgcttgatttattggttcaccgttttttatggttcttattaaatattctagccttgaaaaatatttaataaggatccttattaaagctattggagtaaatttatttttgagtaatacgtcagaaaattttgtaaagttctctagatttttttctgcgacagatacacataaatcttctgaaatagggtctatttctgtcagtaaactttcttgaatattttgaattgtcaagtttttgttgtttcctatatatagtataagtttttcaagttctggttgtaatgcattacagttttgtgataagacattgtgtaaatactgcaatgttgtagcattatattgtactttgttctttgttaggaaatctgatattatgaatgaaagattgtcattatcatctttatagcatcctatggaagcagcatttcgtgaattgtcataatattgtcttaaggtagaatcaggagataactctccagaagttataattatatagttattacctatgttattacttaagacgtgctttagttcctgggagatagatttttctccattagctagtataatcaatttgttttgacagaacatggatatggtagtcagctctataaataatgtgctgggatttttgtttactgtagaaaagtcaatgttgcttatagcaaattcagagtttgtgttaacatgattaatgatttttttcttgtacatgctaatttttccataatcgttgccgtagatgagtatattgtttgtaagttgtagattgttgaaaaaggaatgtaattttgatgatgtaattttcacaacatttattttactaattaaataaaaagatatcttaataaggtatgttttgacaatctattttactatttaatataatttcaatggatgtttgtatgaacttaaatattacagtagagtgggttgaaatttttttttggatcctagtgattaggtaatgtaaagagcatttagtaggggtttctcacaatctattttgttttaaatgtaattaatggcatgtttgtaggtatttctttattgtgtagaaatggtttcaggattcatttttaaatgtttaatattttgttctatacttaaattgatgaattttaaagtcgagatattatatgtataggctataatttatctataaatgtttataattattagcaatgtagttttgtaatatcatattgatatgataaattagtgacattattttgttctgttggtgtaatgcgatgttacttaaatttgaattaatgttagcactgcgttatttacgatctagtagtagtaaattcttatgttctatgattactatgttatctttagtagggattacgttaggagttgctacgttaattgtagttatgtctgtcatgaatgggtttggagaaaagctattaaattgtgtagtagggttaaatggtcatatagtaatttattttaatgatagtgttgattacgattaccgtagtattgcagagtcaattaagggtatttctggagtaaaggatgctgtgcctattactgaaaatcaagctatgattaaatctaatagtaatgtatctggagtggtagttcgaggtatagaaaaacaagatatagagcgtaataatataatagtaaataatatagtaagaggtagtattgatgaatttaatgacggtattgctataggtatcaaattggctgaaattctacatgtcaattatggagataaactaactattgtatcatcagaaagtatatctacggttataggtaatataccacgtatgaagacctataaaattgctgcagtatttgatgttggaatgtatgagtatgacagtacgttggtatatatgcctttgcatgcttcacaattgtttttccattatgataatcgagtaaaaagtatagaggtgtcaattcttgatgttaataaatcatcagaaatgttagagataatagaaagtaagacaaatatgaaaggagaagattggaaaatgcagcagggaagttattttcatgcattaaaaatcgaaagtaatgtaatgttttttatattgactttaattataatagttgcaacatttaatattatttcaagcttgtctatattagtacaagataaaaaaggagcaattgctataatgcgtacgttaggtgtaacacgttgtggtatactcagaatattttgtatgtgtgggttttttataggattgataggtacaatactaggttgtgtattaggcatagtagtttctctgaatattgatggaataaaaaatatgttagagaaaataagtgatagtaatatttttgatcctgtaatttacttttttgatactttgccttctgttttattagtagaggatgtggtaaaaatatctttgttatctttatttctatctttagttgcagctattcttcctgctagaaaagctgcttgtcaagatccagcagatgttttacgacatgaatagtaggggttaatatgctagcaaaagaagtttggggatggttttttatgatgttgataaccacttcttgctctatatgtgctgttttttcttatttagatgtaaaaaaggatctagtagtatttagtcagcaatatagaaaagtcatagaaaatgatgtacggtctgttttagtgcaggtaaatcaaaacttgcttaattcatatttaagtaaacaaaaggaaaattgtcctgtacagcgtatcattacatcagagaataatgatatcataagctgttctaatgaagaatggcttgcaaagcttttgttgtctgtcattaatttaagagaagcatttttgggagatatatcagtaaaaagtataatctactcaataaaacctatgttacttaaacttgatgattataaaattaatgaggctgtagctgagattgaaagattagatagtaaaaaattaactacatttaataggttaaaattttcgttcaaaaaaattgctcgtgagttgcattattcgcggtctaatatggttcaaaaagttttctttaaatgggttgtagtaaaaaatcaacaagatgcactacttcataatttaaaagaagtagaaatctaccttgatgataatctttggagtgatgcgttagatctttctaggaaggaattatcatctgttgcagaactagagctatggatacaacagttagaagatgtagtatctatggagaaaaacatatcattgatatatgatcaattgtcaaaatatataattaagttacctggtgtttcatgattacaagcgttttaatctttgttattgttgcacttactatagggctatgggtaatagattgcgatggtatcatcagaatagattggttaggctatgatatagaagtaaatatcttatttacgttgtttgtcattgctgttgttttccttcttttaattctattagtaagattcattttttgtttttctcgatgtgtgtatcgatataaaagagatttacagaataagaaaatggtcttgttggaacagggttacatgtatttaaattgtggagatgttgaaagagtagaaaagattatagtaaagataggaaattttgatcatccatctttatttttgttaaagggaagggtttattttgatactggaaaatacatattggctgaaaagtattttacgcaatttgtgaaagttgtaccagttatagatgcttcgttgggtatacacttgttgaatgttattatgcagatagaagatcagattcaacagctgagtttattgaggaaaatgctggagattttttttaaacaatcttggtcagctatttttaagttaactatatatcggatttctagagattggggtaatgcaattgaagaaatgaaaaaaataataaagttaaaaataaatctgcctttaccttataatacacaagagatgcttaatgtgttttattatgcattagcaaaacaatgttatgatattcaaaagtatgatgatggtttaagagtacttgataacattaagaattgttctcaacagtgtagtactgctgttacattgttgaaagctaaattttatatagatactgataagaaacgtaaagcggtgaatattcttgaacatgaataccgtattaatccacaccctgatattgcaaatttctatttagatattatgcagcatagtagtcatgctatacataaattatatagttttaatactggatattactttagtatatatcttatagcacaggatgctataaattcaggtgaatatgatacagcaatgaaatatttaaatcatagtttcaaaactaaaacttatatttctttgtattttttagtgttaaaactaaaagtattatcacaaaactataatgaacttttgtattggacagataaaattgcaaaagatgctatagcagataagtattggagttgtacaaagtgtaaatatacccctacctgttggcattatgagtgtgatggttgtaaaagttttaataccataatttgggtttaagttatatgggtattgaagacgttgtattttttataatatcttggtgggttgttttatttttaatactgcctataaaagttgaggtatctgatagtccagtaattggtactgcaagtagtgctccggtaaaatcttatttacttgttaaatcaataattgcaactgtgacatcaatgttacttactggattatatatttatttgaaaattaaaggttacatagattttgaacgtatatatgatcttgttacttttgtatagaaaggttattaatcaatttacactgtaacttttagtttatatgtgtctaagttgaggagttatttgagtgtgtggtgagttgttattcagttaaaagtaaaattggtatattttgatggtatataatatacccattatttatggacttatagaatatttacaagtactggagtatcgttattaagtgaaaaattattgatgtgttgttggtataattgtttacaaagtagcactattatattgtttattaagatataaaatacttgactggtgttgttataatggtataacattttgctgttttatgtttcctttaaaagcatatgattcaatatagaggtggctatatagcatcttgttatgctcaagcattatttagtgtgtcaagtaatgtgaactctatttgtaaaaatgcagagtttgtcgttagtgttcttgagaattgtaatgatatttctttatttttatctaatcctagggtgtcaagggaagataaagtaaagcttgttgaagtaataggggattatattgattctatattagtcaagtttattatggttgttattgaaaataatagaggaaatatattgctgcagattttgaatacctttcttgatttagtaaaaaaacataatagggaagttagtatctctgttacttcatgtgctgtattaacaaagcaagaagaagaaggtatatgtgatgcattatttgagaaatatggaaaagttgtcagtataacaaacaatatagatcctagtattttaggtggttttattattagggtgaattttgacgtaatagatgtatctttaaatagttatttacaaagtttgcgagaacttagtaaaatggctatacgtagtagtataagtgaatagtagggtacggtaatgaataatactatatctccaggtgaggtgttaaaagttattaaggagcgtattgagaattttgataaccaagtaaagtctgatagtgttggtgaagtgatatctattaaagatggtatagctttaatatatggcttagaaaaagcaaaatttggagaagtagtagtttttgctaacggtattacaggtatagtattagggttagattgtgatactgctagtgttgttgtatttggtgatgaaagaagtgttggggaaggtgatactgcaaaatgtacaggaaaattgatggatgttcctgttgggttggagttgctaggaagggtagttgatgcattaggtaatcctattgatggagctggcagcattgatagtaaaactaggttgccagtggagattaaggctccaggtattatcgctagacaatccgttactgagcctctgcagactggtattaaaattatagatatgttaataccaataggacgtgggcaacgtgagttaattataggtgatagaaagacagggaagactgcaatagcaattgatactatcattaatcagaaagcacataatgatgtagtgtcagaaaaggaaaaagtttactgtatttatgttgcaataggacaaaagaattcttctgttgcaagaatagttgataaattacgtgtaagtggagctttagaatacacaattgttgttgctgctggggcttcagatactgtatcgttccaatatcttgcgccatatgctgcttgtgcaatgggagaattttttagggataatggaatgcactgcttgattgtatatgatgatctgtcaaaacatgctgttgcttatagacaaatgtccttgttgttaagacgtcctccaggtcgtgaagcatatcctggtgatgtatttttcttacattctcgattgttagaaagagcagctaaaatgtctgacaaagaaggaggtggttcattaactgctttaccaataattgaaacacaagctggtgatgtatctgcgtatgttccaactaatgttatttcaattactgatggtcagattttccttgaatctgaaattttttataaaggtttacgtccggctgtaaatgttgggttatctgtttcaagggtaggttctgctgcacaaactaaatcggtaaaaaaagttgctggttctgtaaagttgagtttagcacaatatagagagttagaagattttgcaaaatttgggtctgatattgatgtgcattctcagaaggtattagatagaggtagaaggatgatggaattgttgaaacaaaaacaatattctccattatctgtgccggagcaagttgctgtgatatttgctggtacaagtggttgtttggatggtgttagtgtaagtgatatcagtagatttgaagaaatgctccttaaagagcttaatgaaaattatccagatgttttaagtagtatattgaataattttactgatgatgtaaaagacttattattagaaattataggtaaggttacttctaattttgaatagttctgtattatgtaggtatgacttatgaatgactatatgaatgcgagatttcctattacaaaaaatgggtttgcaaaacttgagttagagctagagtcattgaaacatgaaaggcctaaaattataaaatctatttctgaggcgcgagagttgggggatttatctgaaaatgcagagtatcatgctgctcgtgaaagacaagggttagtagaaagtaaaataatggagttagaatcgaaaaaatctagagcagaagttatagatgtttcaaatttatctggggacactgttatgtttggggcaactgtaactatgtctatatatgatgaacagactggtaatactgatgaagtagtgtaccagattgttggtgagtatgaagctgatatttctaaacaaatgatttcaataaaatctcctttagttgtatcattattagggaaaaaagaaggtgatgttgtagaagttaaaactccaaagggtgattatagaatatataaaattataaaaattgaatttatataaaagaaggttatagggttaatgggtattattgtatcagaaaattcgagttttatctctcctgtagagcatattattgaagattctaaacaaggtaaaatgtttattttgattgatgatgaacaaagggaaaatgaaggtgatttggtagttttagcagaaaaggtaacaagtggtgtaattaactttatgataactcatggtagtggtattgtgtgtttatctattacagaagatttaatgcataaattggggttggagtttataccaaagaggcatgttaattgtaatagtgcgtcttttgcaacttctatagatgctcgttatggtattacaactggtgtttctgctcatgatagagcccatactatacttacagttgttaataaaaatgttacagaggatgattttgtaacaccggggcatatttttcctattgtatctaaaaaaggtggagtgttagagagatctggtcatacagaagcgagtgttgaaattgcaagaattgcagggttagctccagtagctgtagtatgtgagttgatgaatcctgatggaacaatgtcaaggatgcctgatattatagagttttcccagcgttataacattaaagttactagtatagataaacttattcaatatgtaaaagcaaactagtgtatgttgggagtgcaatttttctgtggatatcgtagttgagaatcgtaaagtaaggtttaattattttattattcaggaatttgatgctggtattgtattaattggtagtgaagtcaagtctttacgccagagaaaagtcagcatagctgaggcatatgttactgagcggaatatggaattgtggctatgtaatttacatatttcagaatataatcaggcaagtactagaaatcataatcctaccagacctaggaagttactattgcggaaaaagcaaatatataaaatatctggaaatataaagaatgatggctttactgttgtaccattgtgtttatattttaatgataaggggatagcaaaagttaaggttgttattgtaaaaggtaaaaagttgcatgataagagagagacaataaaaactagagattggaatagagaaaaaagtcgtatactacgtggcggaaactaatctgatatagagaaaatagtttatagacttaactttgttgtgatacagagtttggtttaaagtagatatatcaatacatatttattgtaaagcattctcctattactttgcaaaaataggaggtggtaatgtttcagctttataaagttcactggttagtaaattctacttaaactagaaatttttcttcatttttgttgtaaagtattctcctgttacttacaaaaataggagagatgtgataatgtttcaactttataaaatttactggttagtgaattctaatgaaactagaaatttttcttcatttgtatcaattactggttgagtagtgtacactatatgttcagcattgcagacagcttttaagtcattttctagtgaagtaggaaagttacagccttgactatttatgattagcttatctattttatattttactgataattgggcattggcttttattttacgtacttggttaagaatttctataaaatcttctcctaatagctcatctgatgcattgtatagacttatatttgcaataggccagttattgtggctatgaattgaatttttgttgttataaagtgtattgtatatttcttctgtgatatatggcataaaaggtgctaacattttgagtaactctcttaatataaaggatagagtgtgtactgcacttaagtgttcctgtttacttgtagattctccatatgctctttttttagacaattcaagatagttatcgcaaaaatctttccagaaaaaagattctatgtagttaagtgctatacaatactcaaaagaattgaaactttctgttgctttgatgataactttatatagttttgaaagtatccacttatccattgtttctgttacgtgttgtaaatctatttctgaatattgaccaataaacattgaaacaaatttacttgcattccaaagtttagtagtaaaccttttgcctaatttgagaacgtcattggaaaatgtggtatctgctcctaatttggagtttgcagcccaataacgtactacatctgcaccatattcttctaacaatttatttggagttagtgtatttccctttgatttactcatctttgttttatcttctgcaaggcaccacccgctgatcataatgtttttccatggaatatcattattatggtaataggcctgtagaatagtataaaatgcccaagaccttatgatttcatgactttgagctcgtaagtcagcatgagttgtagatatattatggaattgagtggacaatgaactagtagcccaggtatccattacatcggtatctgcttccacttctgtgtcttggtatccttccggtaaatcgttaattggatctactggtaatttgttgatatcaggtaagataatttcaccatctgcttttttagaataccaaactggaaatggtacgccaaaatatctttgacgtgatatacaccaatcccaatttaagccttctatccaaatttctatttgtttacgcatagattttggataccagttgattttttgtacttgtttcaataattcctgctttatttctactactttgataaaccattgatgacttaatagtatttcgataggtgctcctgacctttctgcacattttacattgtgaataatttcctgtttatgctttagtaaattgttttgatctaatatttcaagaattaatgctctagcttttgttattggtagcccatgtaattggttacatacactttttccttgagtggtatcactacttagattgaatatagtgcctgatttgctaataatgattttagtatctaaattgtgtttgttccaccagtatacatccatttcgtctccaaatgtacagcacattacaagaccagtccctttatctatttttacttgatcatctggtaatatttttactctgttgccaaatattggcactatcgcattttgcccaaggagatgctgatatcttgtatctgaaggattaaaaaatacagcaacgcaagctggcataagttctggacgagttgttgcaatgttgattggtattcctgcttctgtagaaaatgttattgtattcatgaacgatgatatctcattttcttcaacttcagcacgtgctatagctgttttatcaatgcaatcccagaatataggttgtagttttctgtataattttcctttattgtataaatttataaatgatgtttgagatatcttttgtatatttttgctaattgtgtgatattctagatcccagtcgtagctaattccaatagattgaaaaagttgtttaaattgtattctgaattcatttgatacttgtgtacatattgtattgaattctttgcgactcatatctgttgcacgtattttttttgttttttctactaacctttctgtgggtaaaccgttatcgtcaaatcctataggataaaatacatcttttccaagcatgcgctgatatcttgcaataaaatctgtatgacaatagctaaagacatgcccaatatgtagttgtccagatattgttggagggggagtgtcaattataaactgattatttccagagtttttccatttatatagttttgttatattccagtgtgtgttgtattttgtttctatatttttaaattgatatttgttattaaaaatagactgcattgtaaaatattctgcttaccttttcctgctcaagtatagagaattgcaattgttgaaacaatgataattttattaatatactacgtaatctatatttgttgatatgaacctatattcaaagatgttgtttgtcattttactgaggtgatttttgtattttcttatctaaagttggtacgtttttaatgtgttgttgatgctaatgttattatattgtgtataagaagaacgccttgggctatattttataatataccttgaaatatttatttactataattgttttctgacataatatcaattattggttctctataaagctacactttgcaagttttaattaaagccttataatagataattcttattttttgaatattattaagaagttataatggttagtttaatagagctcccgcttttaatggcgtgtgtattttcagtagtttatccatttgttgttaatatatctttctgttggtcgaaagtactgacaatgttgatatttatactgacaagttctgctgttggattgttgttgtatatacacattgttgatgatttttcattttgtaatgtatactataattcacatacgactaaacacttattgtataaaatatttggtatttggggtaattatgaaggttctattctattgtgggtgtggataataagtctatatagtttattattagagattttacttgataaagatgatttcaaaagaatatccatttcaatacaacatgtaattaactttggattcttgttatttaccttggtagcatctaatccttttatgaagatgcctactgttgaatatgaaggattgggctttaatcctatattacaggatacagggttaatggtgcatcctcctattttatatttaggatatgtaggatttagtgtagtattctcacttgctgtagctgggataattctccaaaaagatagtgtagaatgggcaatgattataaataaatgggctctagttgcatggtcttttttgactttaggaataggattaggtagttggtgggcatatcgagaattaggttggggaggattttggttttgggatccagttgagaatgtatcacttatgccatggttactgggtacagctttaattcatttactgcctttagtgagaaaatttaacctgttctataattctgcagttttattatcaatttgttcgtttgtaatgagtctaattggtacatttttagtaaggtctggtgttttggtatctgttcatacttttgctaatgatccagaacatggattctatatattaatgttaattggaataataattagtagtggaataataagttttatttgttttacgaagaaaactcagaaaagagaatatgattttttattgttatcgaaagttacaatgttgttgttcaacaatgttctactgttaacagcatttgctatagtgtttattggtactatatatcctgttatattagagtttatcactggagatgttattgctgtaggagctccatattataatactctatttaattatttgatattctgtactttaatattaatgataattactttaggattggatgaggaaagaaataaaattttaataaagaatttcaagttttctggatttgtagttttattgatttttcctttcatgatagataataatttttttattgttttaatacttttattatcagtttttttatttttatcagtgttggaagcatactatagaaaaataaaaatatttacagtgtcattttctgaaactataaaattggctaaatcttgctctaaaaaatattattctatgctaatagcacatatgggtgttgctgtatttatgtttggaatcattggttctattgtatggggtgaaacctatgaactttatatgaaggacaatagtttgattaatgtaaaaaactttcaagttgttttatctggattatcttttgtaaaaaataaaaattacgatgctattcgtggaagatttttaatagtaaaatctggtgaagtgttgggtaaagtatttcctgaaaataggttctatgtagttgagggagtaagaaatgctgaaagtgctatatatcgacattggctatctgatatttatattgtaattggtgatatagataaggtgaaaggtatagcagtaaaagtgtattataaaccttatataaatttaatatggatgggatttttgttagtagcatttggtggcgttataggattgttatctagtcatattattacaaagaaatctttagtacttgaaacatcaaaaaccaatggtgcttcttgtacatgaaaaatatggagtgacgtgttgtaagtatggaagttcaagtatatcaccaaatctgccgttattcaaagcagaattgtgttaaatattacatagaatcaaagtgttgttattacatgctatctatgttgctgtaagtaaggtaatattattcttctataactgcaagagcttgatgttgacatagttgatttttaagtttgtgatgatatataaaaaacaatttttattctaaattgatatagcaagtgtataccaaatttttgtaataatgcaaattgataatgtgtatttattgtggaataacaattgcatgatcactttttataggcagaattaggttgacattctaagtaataaaagtatggaggagtatgagcaagtttataattttgcctgatagaagtattatagtcttctatggacaagatgttaagcaattacttaatcaaactacaacgaataatgttttaaatttaagtcaaaataaagctatttattctttgcttttgagtcctagtggtagatatatttatgacttctttattgtgcaatatggtaaatatgtattgttagattgctgtagtacagaaaaagaggaaattatacaaaagtttttgtcgtataaattacaattaaaaatagtaattaaggaaaaaaaacactataaagttggtgtgtttattggggatcagtatgataggaatgagtgtggatatacttattgtcaaggtgatactatattctttcaagatcctaggttatctaaattaggtttacgtgttatgtttaatgaatcccaaaaagtatttagtaacatagaatatgatgttggaaaatatgaagattatgaaatattgagaattaataatactgttccagattgtagaaaagatatgataaaaggaacctcatttcctttgcagttcaggatggcacaattccatgcgattgatttcaataaaggttgttatatagggcaagaaactgtagcacgtatgtatcgtgctggagtgaagaaaaatatatatactataatttctgaacatcagtctttttgtgatacgaaagttatgtgtgctcagcaggaaataggtagattattgtctaatgttggtaatataggattatgtttgttggatattagttcagagcatgatttttgcaatttaaaaattggtggtgctaaagttaaaatactacttaattaatataggtctttatctaatttctttttacttaagatgtataactttcgaattatcctgttgcagtgtgaataacttttattttttaggctattctatgattctgttctaagtaaatatgctagttactgattactgaattttttgttatagaaatttcttatgtataagttaactgtaatttttataggaaatgttatatttattttactatagaagtgagctggttttgtaagattattctcctataagaatgtgtatatagtgtagatcacttttatctttcaacatcttttatgttagggcggtaattttcattcaaaatatgataactttataagtaaagagttatttattatggttttacgacaatagtacatgtgtttgactgttgaagactgtaaactttatttttcaatatcacacttattctatttttcctattggataatccccagtaaaacaggcatcacagtattgaggtatactattattacgttttgtgttgcatattgccttgtagagaccatctatacttaaaaagtgtagactatcgcaaccaagagcatttttgatctctaactgtgataacctgttagctattaattttgattcttctggagtgtctattccataaaagcaagaatttatagttggtgggctagaaattcttaaatgtatttgttgaactcctgctttgtgtagtagtgttattatactttttagtgttgtgcctctaactaggctatcatctattaaaactattaccttgtcttttagtatggaagaattagcattgtgttttaacttcactcccatactacgaatgtgatcgttgggttggataaaagttcttccaatataatggttcctaataatgccaaattcaaaaggtatttttgtgtattctgcgaaccccaatgcagctggtactcccgaatctggtactggtactatcatgtgtgtatcttttggaataggattttctattgctaattctttacctatgtttttgcgtatttcatatatagacttattgtctattatactatctggtcgtgcaaaatatacgtattcaaaaatacaaaaacttgatttttgttttttaaatggaaaagaacttgttaaagtgttaccttggtcaattgtgatgaattctcctggtaatacatctcttataaattgggctccaactatatctagagcacaagtttctgaagctacaatatatgaattatctaacatacctaatactagtggtctaattccagctggatcgcgacaacatattatagtaccgtttattaatataactaaagaatatgcgcccttaatggtttttaatgcattaataacattgtccaagagagtattctcagtattaatagcaattaggtgagcaatgacttctgtatcgatatctgatgaaaatatacatcccctttcagtaagtgattttcttatttgtgctgcattagtgaggttaccattgtgtgctattgctaatttcccaaatttacaatctaaggttattggttgaacaccaactttacttccacttgtagaataacgtatatgtccaattgcagtgtttcctagtaaagagtctatttttgattgttgattgaatatgctgttgacttgttcatttgaatagtgaaaatgaagtttgttatcttctgacgttactatgccaaatgattcttggcctctatgttgaagtgcatgtagccctaggatgcaattaatagcagcacaattattattttgtatggcaaatactccgcattcttcatatatttcattaaactgcatagttagtcgagaatagaactattagctaatattctagcatagaaatacagaaattttaataaattatctgtgattattatgcttgtcatagtattgttatataagtagtaaaatttttaggatataaagatattttaggtgtgaaatattgacagtgtagctatacattataaatgaacttaagggattattgatagtttggatcatgtgttttcaatcctccactacatttaataaagctatcaaaaacaaaaatataaatcatgtaatatatcaaaaagttattgcaacattacaaaatgaaaataggatacaagtatcatttaatgatgcactgtttacaaattataactctagatctcctgaaaatactggtattcttgccttactaatattgataggacgtcatagtattatgtaatgcctattctgttggaatatcttcatattttataaggtttttgactttctccataaacattgaaggttttttttctaaaagtaatgtgatatgttctactatgttgagtatagtgttattgactgctttaatgttatggaattgtgataggacataatatgatagatctatcttgagatttgttttatttatgggacgaccaatgccaaaccttactctccaatagtctttaccaagtagattatcaattgatttgagaccattgtgtccagcattgccaccacttttttttactcttatggtacaaaagtttatttctacttcatcatgaaaaattattatgttatctaatggaatcttgtatagactggctatactcatgataggagcacctgaattgttcataaacgtccaaggtttaacaagaataactctgtgtgatttaatattcccaattgatatcagtgcattatgcctttctctgaagcttggaaagtaaaactcacttgctattgcatctacaatcataaatccagcattgtgacggcttagctcatactttttaccaggattacctaacccagctaacaggtaaaacataagagtttaagtcactaactttctgatgatggagtagtacttgtagactcttgattactttcagcttctttttctgtacttgcactagagattgttactattgctggattatgctctttcatagtcacattcacctctggaggaagttttaaatcgcttacatgtatagaatgtcctgtagttagaccagataaatctatttctatattttgcaatatagctttaggggaacactttatagataaagtacgatgtaatatgtttaatactccacccctcttaatgcctatacatttttgttcatttgtaaatattaaaggcacttctatttttatttctgtaccataatcaataaactggaaatctacatgttgtattctatcagttactgggtgcttttgtacatcacgcattaatacatattctttcttgttatctatttcaagttcaatcaagtgagttgacaatgcagcagatctatatttgcttacaaactctctattagataaagatatgctaagggaatcacgacctttaccgtatattactgctggtatttctccgctaagtcttagtgcacgtgaagggcctgtgcctacatttttccttaaacttgcattaattttaactatgccttgatctgtcattaaaaaatccttttgaaaacttttttgatttaatacttctgaatcttatattcttaccatattaagatgatattgcaatataaaaattgctatgttagatatttgaatttttagtggcaatttatcaaatgtatagtttgtgtagtgaaaaattaataattctaaggctcacatattcgaagagtgatttatatttaattaatgctataggatggtgattttttgtatacgaagataaacataagtagaaaaatcttatattactagtgagtagatgttaattacaaaaacatggaattttgttaaactgtgaaatggaataagtaataaaaattggataaagtgatttttactataagatgtataggtttagcttataaaattgttatagtgttctagctaatgtaataactctaacttcttttgcgcctgattcaatgagtttatgtgtacaggtcctgactgttattccggttgtgatgacatcatcaacaagtagtataattttattattaattaaatgttgattttttactgtaaaagattttgtaatattcttttctctcattttactagatagattatattgtgggattgtatctacgatcctttccaatacaaaagtttctataggtatattacaatatttacttagggccctagcaaggagagtagcttgattatattttctttgtcgtaacctttttttatgtacaggtatgggtattatagtagtaacattgttaaataaatctggattctgattgtacatccacttcccataagttttgacatgtaatgtattgtcagagaatttcagatttagaatcatatttttactgtgcttattgtatgaaaatacagattctaattttgtaaattttggtggattaggcacacactttccacatattgatactttatttggtagactacacccacatgcaatgcaatagttgtcacataaaaaatttatattacttttacatgtactgcataagtcgtggttagaagaaattacacattcacaatttgcgcatgtcttaggaaaaattatgttaaaaattttccctagcacttagctactgagatatattaaaaaactgctttatgaactcttcgtatatgttagccagtttgtttatgtcatctacagatgtattttcgtttattttatgtgcggtatcattttttaatcctagctcaatcacaggacaaaaatcttttataaaccttgcatctgatgtgccaccagatgtacttattactgcagtttccccagttgtcttttttatggctgcagatagcatatcagaatatttgtcagggtaattaatgaatggatctccagataatgatgtaaatatttggtatttttgtgttgtttcagcacaaatattgttgattatattaaataatgattcagaggtgtgtatattattatatctaatgttaagatgagcggtaactgtgcctggaataacgttatttgctgtatttcccacatcaacagatgtaatttcgcaatttgaaggttgaaaatattcattcccttcatcgagaactgtattgtttattttatgtaaaatgttgatcatatcatttattggattttgtgcaaggtgtggataggcaacatgcccttgtacaccattacacactatcttgaaattgattgaccctctacgacctatttttatagtatctcctacagaggatttacttgttggttctccaactaaacagtaatcaatttttttattattatcggttagccatttcaatattgcaggtgtcccatatttaaaatggttaccttcttcatctccagaaatcattagactaatagcaccatttacttgattgaaatctattcttgatactgctgctatgaaggcgcatatggcagatttcatatcaacagctccacgcccatatagaatgttatcttctatgtgcccagaaaaagggtcaaatttccatttttctaagtctcctgttgggactacatctgtatgtcctgcaaaacatagattaggatgaccatttcctaattgtgcatataaattacatacttgcacttcatcatttccaaaagttaaaacattacatgtgaatccatattgtgatagagtgtttgatagaaagtctatggcaccgttatctgttggagtaatgctagggaaggatattaattcttgggataatattactgggtcaatagccatagataaacctatatagaatatatatttattgtattcttgttgtaatacactgtcaatattactacttcgtagtttaggtcgttgtaaatgttgctatgattttgtatgtagttataaactactctttaataatatgctgattattggtttgtttatatatagataactcaatttttatgtagtgaaatataattatattttactctttaaattatattagttgttgaattattatgtaacatttgttggtttgtgtggcagaggttgtggtggacattgtgttatatggaatggcttatagttttatatgctctaacttttacattagaattaactgttaagttattatatgtaagtggttagttatgctttattcaaaacatatattacaagcttttttgagagttgtgtagggtatcgttattctcattctaaatcagattattcatcttctttattttttacagcatcataatttaccattctaaatctgtctttcaataaagaaatagcatggttactaaacccgttgttactcaatgctacagcacctaattgtaatcctacttcatatgtttcagggattaaatagtgagctccaagctctttgtatatttcaacattgcttaagtcaggcaaccttacgatgattattatatgtggaaagttctttgcaacaagggaaataatcttttttatagtaacttcgttgttgattgctatgatgatcattctagctcgtgatattgccatagactgtaaagtatttagttttgtcaaatccccgaggtatacagggaatccttcgtctattccatctttaacaatttttggttgaatgtcagatgcaatatagtttacgtgttctgcaactagtacttttgcaaccatgcgtcctactctgccgaaacctactactataacgtgttggtctaagtcttttgtatctaagataagctcttgagaatttaaagatattttctttttagtaattaattttgatatccaatcccctaatgttgccagtaatggggtgaaagccatagtaactgttgttatcatcatgagagtttgcgctaggtcgctggatagtacgtttttttctgctgcaagaccaaataagataaaagcaaattctccaccttgagataataataacccagcctgtattgctgctgcaagttgaaatctaaagaacctgcataatataaaaattataaaagatttgagtgctatgagagatatagaggctaatgttattatagggagtttattcagtacaaacttaatgtcaattgacattcctactgtcatgaagaacaaccctagtaatagccttttaaatgggaggacaacttgttctacgtcatgtctatactcagtttctgcaacaagaagtcctgaaacgaatgctcccagtgccattgataaattaaagttttctgtaataaaagctgctcctaaaacaatcaacaatgtcgtggctatgaaaatttcattgcttttcattgctgcaatagtattgaatagaggtctaagcaataacctccctgtgatgaagattaaagttaaggcaattgctgcttttacaaaagagtataatagtgatatggggatactatgatgtgattcccctgttaacagtggtaataatacaattaatggtacaactgcaaaatcttgtaataataaaactgctattgatagtctaccaacttgagtagattgatatcctttttcttgtaatacttgtagtactattgctgttgaagaaagggctagggctcctcctataataatagatcctttggaatctacaccaaactgacttgaaatataccatattgctaatgctgttactatgacctgtaatgtcccaaagccaaagacatgcaatcgcatggcaattaatctttcaaatgtgagctcaatacctattagaaatagtagaaaaactactccaaattctccgagattctgtataatgacagatgattctactaaatttaaaccatttgatccaataagggttcctgcaacgaaatatcctaatacgggactaatattcaacttccaaaatagtacaactattactatggctgctgaaaggagtgtgatgatgtctagtaaatacttggaatcgtgcatagaaagctcttaattaggttacaaacttataatcctgagacttccactttatggagcaaccaatacttggtttttgattttcaggtgattcacctgtttttgaaattaatttcatagcattaaataaatctctgtcttcttgtttactgttcatctggtttttccctgaagcatcaaatcttcctctatagcacaattctaatttattgttaaatccgaaaaaatcaggtgtacacacagcaccataattccttgcaactgtttggttttcgtctattagatatgggaagtcaatactatgttcttgtgcaaaattgatcatattatcaaatgaatcttccggataagtaatagtatcatttggcataattgctacagtgtaaatattataatcgttctttaatgtgttcacatcatacaccagattgtttattattgccttaacataaggacagtgattacatataaacattatcaataaaccattacctttatgacagctgcttaggttgtataaattgccatctatagatttcaataaaaagtctttagcgataaactttttatttaccggaggggtattaagcgctaccataactatatttctcaaactataaacaacaaaactttatgcactactttattctaaaatacaatcttttaaagtcaaatttaattatactgaatttgcgaaaattacataaaaggttttactacaaccataatcacaataactattattagtagagttacagactcattcagacatttaaagtataataaggacttagtgttgctttttgtgacaaaatctcttctatgtttaaatagcatcatatgtattatacacattaatataacacatgttacttttatcttaaaccataagaagtgatatgcttctgtcataaaagctaaaattacaccaagaactatactagaaatcatggatgggttaattatatagaataataaccttttttccatagtattaagtaaactatagctatcagaatgtagagcaacttgcacgtgatatacgtataatctgggcagatatagcataccagccatccaagtaataattgatattatgtggaacgcttcaacccaatgttcatagtctatcattgtaggaaccagtatatgaaaacccttctaagtatacattatatgtaatattcttcagaatacaattagaatatttataataaatgtgtaagtttttatattatttcataacatcatgactttttcaatgaatacatttaagaatagtttttgaatgtttatattgttcaaaaggtaagtgatattttgtttaaaatgttgatgcaagtttttaataataaactatattgctaaaatatttttaatatgcttattaaatgcaaatttatgtgtttgggtaaagagttttgtttaataaaattgctataataaacttaaaatataattattgtagattatgactaaaatatcaatagttatataaaagcactgattaaaaacacaagatttattgtgtggtttattatgataaggtatatttgttatgagtccaatgactctaatgtttgaatccagttataaatatgaaagaacttggaatattttaaagtgttaaagattctgatagtcataattatctataattgcgaatacataaagcacgtgctgcttctagtatatcttcaatttgtggtaatgctaacttttcaaggtttgtagcataaggtaatggtacatcttttccagttattcttatcattggtgcatctaaatcatcaaatgcatattccattatcaatgctgctatttcagatcctatgcctgaatatggccatccttcttctatgctaataattttgtttgtttttttaatagaacgtaatattgtttctgtatcaagagggcgtagcgttcttaagtctataacctctgcatttataccttcttttgctaaaagttctgctgcttctagtgcgaatttaacttgtagggaaaacgctgttattgtgatatcagttccttccttgactatagctgctttcccaatttcggttatatagtctgatgttgatacttcatttggtatttcatgcttatgtccatatgcgatctcattttcaagaaatacaacaggatttaaatcccttatagctgcctttaatagacctttacaatctgctgcaaaatatggggatactacttttaatccagggatgtgtgcataccatgaagcataacattgagaatgttgtgctcctactcttgctgctgcaccattggggcctctaaatacaataggacagttcaattgtcctccagacatgtaactagttttagctgctgagttaataatttgatctattgcctgcatagcaaagttgaaagtcatgaattctacaataggtttcagtcccgcaaatgcagcacctacccctatcccagcaaatccatgttcagttatgggagtatctatgactctatcagggccaaattgttcaagtaatccttgggtcactttgtatgcaccttgatattcacctacttcttctcccataattagtactgtatggtcgcgttccatttcttcacgtattgcttcgcatagtgcttctcgtacagttaaagttctcataatttggcaatcttgataacaatcttgaataaattatatgtaaaaaaacacatatgcaaatacaatttactaacttgtatttattttactaggatgaagcgtaaaaaagttaagactaatagaatttactctgagttatatgtaatacatattctgctatgttaagtaattaatttttattatcaataaatttaatcctagtagtttaattaatatacttgagctattttatttattagatgtggtagattgtgggtatattttacgatatgaaagttgaagtaaacgtataatacattttctgtgttgtttattaataattaaaaatgatgaagagttttcagttagtatgacttgtataataatacatggtgtgtaccagtgattgcatattgaaaaatggtttggagtttgtaattatcacaaaatagctaagatataagtatataatgctatagaataaagaatctagtatgtattagttgtatttcctaggaagtatatgttcctggcatatttcttgttgctgctatgtctgttgggttgcttacagtagtttcaacaaggttgttaggtgttttaatatgatagtacaacatagcccctataaatgctattgcagcaatacaaaaaatactaattactgttattgattttatattttccatctcgctactaacataacaccgaagaggaaataaaactcctataatgctacatattgtcaatgtgctgatagttatgtatgcaataatgagatttctttttgagtgctgtatatttgttgacctatatatttgtgtacgttttacaggttttatagtttttcttaatgcagatatgtcttcttgtattcttgctatgtaactattgtcttggacaatagatggtagaaattcccgttgtctttgtatgtctggttctatagttgatgatgtagcacctgaagtagaagcttgtacctgactaagtgttggagtggtagtagatagtgatgtatcctctgttgttggtgtaatgtcatctgaaataggggttagaggctgtatttgactaggtcttgaagtggtaggatgtgatagtaagtctgttgtttgtagttgtgttgtggtctgtaagcttggttgtgatgtgtgtttcgtgagtttgtgtcttgttattaattcaggatgttgtgtagattcaggagtagttatttgatcatcttgtgtagcaaaagatattgaatttactgtacttatttgttgtgatatattctgactgggaattatatgtaaatatatatcgtatgaattgaggcatgctttaactatatccgaagtgttctttttggaaaatgctctggaaacagaatggtaagatatgttacatacagtgcataataattttttgatgttagtatgagtgttaagatctggaaattcgaaccttggttctagtgtagtgttatgtgtaatagttatatctttttttaatgaaaattctagtgatagtgctaggtgttgcgtaccgtataaggtactaaaagtaaatatatagttgtgtatttgattacaaaacgtttcttctgttaaattatggcaagtgattttataagttactgcatcgctggatgctgttggttgtttgtgacatgttaaagaacattcttgagggtcgggtaatgtgttaaatgcttgagaatcgattttgtatattgtaaagagatctagataattatattgagtgctgcataatcgtttaataaagtctgtagctgatgttctacattgtggatcagatgttgttatgcatgctgatattgatgcgttggattttttattttgtgggtctttaacatgaatcacagctagcttcaagtcttttggttgagaatcaggaattaatgtagttgttggtgagttattgtataactctatgatagaataaagtttgtatattccctttacagtaggtaaattagtagctaggttattgtttaatgtatttatgtcgaatggtatattaaatattgtatcaaaagataaagttaattgttgattcagtcctattataggatgtttactgagttcattagatagaaggctgctaataatagatttcaatgcacttgtaattgttattttatcaaaagaagtttgtgataaaattgtagatggtagtattgtttcgctttctgttgtattgttgacacgtattttaaagtgtaacggttgttgtgttagtgatggcgcgtcaccagctgaatttgaataatatggaagaataaaattttttgtaacataaaattctaaaaagttgcacaaagcttgcgaaattctacttatagtaataggcttgttctcttctacatgatgtaatgtgtaagatattttcagtgagtcttgatgtactttgtgtgatatattatgtgaaaattctgggagaattgattcccctagtgctgcgataacgatactattgtctggattgatagtgttagattcttgtaattctggagatgtaagcatataaactgattataagttataaaaaagcaagtgcccgaaagaagagttgaacttccacaatcgtaataattactagcacctgaagctagcgcgtctaccattccgccattcgggcatatagtagttgatttattaacaattatactataacatgttaattttatcaaattaaatctgtatggttatgaatatctccaatgtagaacagatgcttcttgctcataatcaagttaatgagagtactgtgaatcgtattgttcgtgattgtttgtgtgtggcggatggtggtgaattgtttctagaaatgtgtgtgtcagaatcccttggactggaaaatggaattttaaagtatgcagattttaattcacatcaggggtttggtttgagatccttttgtaaggaattgacagcttttgtttgttcttctgaaattactgagcaagaaatagaaaatgctgcagctttagtaaaatctattaataatagtaatagtgggggaattgtacatttaaataaggcaaaacctattttatatcctgagactaatcctttacagaagatggattttgatcttaaagtgaagcttctacaacaagttgatgattatttacatagtaaaagtccatatgtaaggcaagtaaaaagttctttaagtggtcaatggcaaatagtttatattattttacctactggtgatagagtttatgatgtgagaccgcttataagatttaatgtgtgtgttattttagaaaaagatggaagaaaggagagtggttcttcaggtcatggtggtagagcttcttatgaggagtttattggtgatggtaaatggcagatggtggctgatgaagcattacgtcaagcgttagttaacttggaatcggttcctactcctgctggtgaaatgacagtagttttaggccctggatggccaggagtattattgcatgaagctgtaggtcatgggttggaaggggattttaatagaaagaaagtttctgccttctcaacttctataggtaagaaagtagcggcgaaaggtgtgactgttgttgatgatggtactataccgggacgtagaggttctattaatatagatgatgagggtgtatcttcagggtataatgtattgattcaagatggaatcttagtgaattatatgcaagatagaatgaatgctaaccttatgggtactacttctactggtaatggtcgtagacaaagttatcaagatgttgtgatgccaagaatgacaaatacatacatgttgccaggtagttattgtccagaggaaataattgcaagtgttaaaaaaggtgtatatgcagttcacttttccggaggacaagtagatattacatctggaaagtttgtattttcagcttctgaaggttatttgatagaagatggaaaggtaacatgtcctgttaagggtgctacaattataggtaatggtcctgatgttttgacaaaagtatcaatggttggagatgacttaaaacttgatcctggaattggtacttgttctaagaatggacaagatgtacctgttggagtagggcagccaactcttaaaatagacagtattattgttggtggtacagaagtttaatttaaaagatctgtttacagttgtatacaatattagttcgagtaaattactagtatggggattgtattattaacatgttgttactaaaaaagacagatttatcaaagtcaagaaaaaatcataagtactaatatagtaatgttgttagaagaaatagaaataatgtaatatgttaatgattggcaaaaatagaatgaacaattgctatggaaggtgcaatgtgggatgtataatatacaatttagaagaaaagaataaaaggttattacaacagtattggaagtatagcataatagtataaggttatgtaaatagggtactaattaaagaacatagggaaaattgtgtatattaatttcatagtgttagggggtgtagaataaacatttatttattatgcctaaagtgtattatatctccatcttgtacgatataatctctgccttcaaacctgacttttccagcttctttgcactttgcctctccattgtattttatatagtcatcaaaactaatgagctctgcttttatgaaccctttttcaaagtcagtgtgtattacgcctgcagcactgctagcagtagagaatctttttattggccaggcacgtgcttcttgtggacctaatgtaaaaaatgtaatcatatctagcagatcatacattgtttttactacagatgttgtaccagattcttgtaaattaaactcagctagaaaaatttgtttttcttcttctgtttctaaacttgatacatctgcttctaattttgctgaaatacaacaaaacttattatgttttttttctgccataagttttactttttctgataaagcatttccagtggttacattcgattcttctacattacatacgtacatcataggttttgttgtaatgagttgtagttgttttaaatcatcgcctaggtgttttgcactttttgctaaattgccagcttctagcacacttaatacttctaatatagtatctaatttctttctgggttctttattagcttttacagctttttctgttgcaggtaagcgacgttttaaactttcaatatcagctaaaatcagctccatttctacaatttctgcatcacttattgggtctacagtttggttaacatggctaatgttttgatctccgaaacatcgtaatacatgaataatagcatccacttctcttatatgacttaagaatttatttcctaatccttcaccttgacttgctccactgaccaatccagcaatatcgacacattcaacttggttgtatataattttcttagaagatgctatgtttgctaaagtttttaacctatgatcttgtactattgctttgcctatatttggttctattgtacagaatgggtagtttgctacttctgctaccatagtttgtgttaatgcattaaatagagttgattttcctacattaggtagtccaacaataccgcagttcaatcccataataatgatcagtaattgtaaaattaggattgtatcattaattacttacttgtgatacttataaattaaataagaaagtgtttatatgtttgtgtagagttgattttcctacattaggtagtccaacaataccgcagttcaatcccataataatgatcagtaattgtaaaattaggattgtatcattaattacttacttgtgatacttataaattaaataagaaagtgtttatatgtttgtgtagagttgattttcctacattaggtagtccaacaataccgcagttcaaccccataacaatgatcagtaattgtaaaattaggattatatcattaattacttgcttgtgatgctcttgtgatacttataaattaagtgagaaagtgtttatatgtttgtagtgtagagttgattttcctacattaggtagtccaacaataccgcagtttaaccccataataatgatcagtaattgtaaaattaggattgtatcattaattacttgcttgtgatgctcttgtgatacttataaattaagtgagaaagtgtttatatgtttatagtgtatttataacatatttgaaaagttagggagaatctatatagtatttattataaattcttattatttgttcagtattatcagttgttagatattagtgtctgtatttatgaattttacttaggttgtaaattaacatgaatatatgtgttattaatattgttacgtgttggatatgatataaatgtattttatttaatgctgatcaagaaccagtgctaatactagttttgtaagcagcatagaactatggcttgagcagctattccttcttttctaccaagaaatcctagtttttctgtggttgttgctttcacgttaatgcacgatggatctatgcatataagattagcaatgtattcttgcatttctaatgcgtgtggcataatttttggttgttcacatataatagttatatcggcatttgaaatagaatatcctttctcttgtgcctttttttgtgcttctattaaaaagtaatcagatttaatatttttccatgtattgtctgtgtttggaaagtgttggcctatactaccacatcctactgctcctagtatagcatctgttaatgcatgtagccctacatctccatctgagtgagcaataatctttttatggtagttgatttttattccgcatattgtgataaatgtattagcatcattatagcatgtattatcaaatttgtgtacatcgtagcctattccgaccttaaatattggtttattgggatgttgattcatagaacagttttatttcaataaaaagcgagctggtatttttatactgtatttttataggaatggatatacgttgtttaagtgcattgtttaataattgtgatctatatgtttggtatataagattgctctatgtaaatcttctatagttgtaattttaaaattgttgtaatctccttcagttgtcattattggtatgttgtaatgtatcataagagatgattcatctggaaattctctgttgggttcagtattatatgcaattctatgatgtagtagtatttcgctatatttatatgcttgtggtgtttggattaatttaatactgttcctgtcaacattttgaataacagtcttgttttcatgtactacatgaatagtatcggttattgaaagtactggaacaacccctgcataatgagttagtattgattccattgtatctaatatctttaaatctataaatgggcgacatgcatcatgtattatgacaaaatatggatttatattttgaatgctctctaatcccatacgtacagaatcctgtcttctttttcctccataggtaggaggtaatagtttatcattttgtattttttgtaagcaattatcatataaatgttggtgctcttttctaatgactactttgacgtaattaatcttaggatgtgagatcatattattaattgtactgcaaagtatattatgattacctaatgaacaatattgtttaggaatagcactccatttaaatctattactgttaccagctgcaacaattaacagtgtgaacttgtgcataaatttttgtatggcatgatcttaactaagattatcattttaaaagtcttatcgtaattgtacaacataaatgttctatggtttagtgcactaattaagatcagtggcgtatttagttgttagttaaaattcaatgcttgtaataattaataattttgatataataaattaatatttttattctatttaataaagtaaaaatattatattaatatttatggcactaaattgtaattgtatatgataggtggaaatactcaaactcctaatgactatgttcctataagaaggcatcaactttctcataatagtataaagtcgttaacaaagaaattatttttgttaaatactagtataggtattgtgtctgtaattcatgcatcatttttaataatgttgtttgatgctatgtgtttacagaaaaagcctaagcatactatcttaacattagcagctttaatagctgtaatctctgttgtatctctgttgttattctatgttagatatacagtcagtaagaagaataaaagacatcttgaatcaatgcatgcaaatgctgagtcttttgtatctttactacaggaccgtcaattgttggataatttatcccataaagttcatcacttacaacatttagcacatgagttggaatccatagatgagaaaggtgtatttattgagcatgcttctcagagaatatctgcttctagggttgatgttgagaaacaattgcgaaattttgttaagcattgtgaggatgatatatctaaaatgtatagggaattagagggtgtgactgttgatatgtctgaagtgagtggaatattacttaatcctagtttttttaaagagaatgaagcagggttgatgtctctatctgaaagacgtaagttaatgagtcaaaaagaacatgaaattaatctcctgatgaagggttactgtagtgaaatattagctaaaatagtatgtattattgagatgatgaagttacatcagtcttcttctgtagaaaataaaaaggtttctctttttagtgaagatgatagtaaagtgaaagaattaatccgtattttggttaatactaaatgtgtcttagaagaattggatggtgaagagataaaatatcctacatttgaaatgttatgtaatgttatgtggaatataggttcttttttatcaagtatgcgatgtatggcaaaggagagtgtatataaaaaagctgaaaatttaattcaagaaaaaggtaaacaagtacagagatttatttcaggtatattatctgctgttcgtaaacttgatgtagtaaaacaagaacaaggaagcgaagcaacttcatctgaacatactatgtcagaggaggattctattgtggctttacggttagtgcaattgcaaagtataattttaaaattgttgtttattatgcaacggaataaatcatatgacattcatacagaaacttgcagtgaaaattcaaatgggcctattgatagtgaagagaatcctgattttgctgtccagaacttgcagagtgtatcatgttctggtataatgttaacataatgtactgtatttttgctatttttttcattatctagaaataatgtattttaatttttattaataattgtgaagtaatatgctaattgatcaaaaatttcaacacttaagtcaggcttttaatagttattctacactttatcagcgtaataagttgaagtcaaagtataactttttattaggcagtagtatatatttaactgcgctagtgagtgtattctctattgtggcattgtatcaccatagtggatgctttaattcaatatttagtggaaaagacaaattatttggtgggaatatacctgttgttttttcaatagcattaattgttgctataccatcttttatattgttgttctttttaatttataagatatgtgcaactcaggatataacggatcacgttgtagagaggactaatgatcttatagggtctgctagagaagtttgtgagtttttgaaagagaagttacatgaaaatacgtgtcaagttgaggcgttggtaggtcattacggaagtttagcggctaaacatgatgattttgtgaaaaaatgtagtcgttgcctacaatctctagaagaacagcaggtagcacttggtgcattggttcgtaggtctacaagtgttgtagataataacatttcagaggtacaagctctagttgtagatttaaaagcaaagatagctgaaatgtctgttgctcatgtgaagttaatggatgcatcagaggatgttagggagttcatcgtaaagcaactgagattagaaggtttgggtttacagcatagagtgcgctttctcgacggtttacaaggtactttatcgcagaatattgatgtaagtgatgcaaaatctgcgatgaaaattattatagaaagaatagaaaatgagataccaaaagtaaggtttgcgtttaatagtcttaatagcatgttatggagtttacatagtaatttattaaaagcattgttaggtctagataaagatagcagtcctgatggatgtattactgtttgtcaggaattagtaaatgcattgcataaattcttgggtgatatgagagctaaaatagacaattataatggttctgataaaagacagtttgttaatattggattagtagaagtaccattattacaaataatgatactgcgtttgatggctacaaaacgtgcctgtatgtttgaagatgtgtgcgcatctgttaaagattttattgaaagtggaactgctgatagaagtagtagtacaggaacaaaggttattcctgattctgcagcctctgcagctgcacctgtaacacctacagcatctgtaacacctgcagcatctgtaacgcctgcaacacctacaacacctgcagcatctgtaacacctatagcatctgcaacgcctgcaacacctgcagcatctgtaacacctgcagcatctgtaacacctacagcatctgcaacacctgcgacacctgcagctggtactaatgatggtgcagaatttgcaacacctcctatgggtactactgatgctccgagtgtggaagatctgagtgctttaggtgctgtaggtggtgttgatcctaatgcacatacacataccccgtagatgtgtatcataggtattgatggggtaaatatgtttgttaaggtttgtgatctattttaagtatagaactgaactgtttgtatggactttttatatgttgctacgttgcattgtactttttatgtagccttatacaaaggtgtataacttattttacagtataaaagtctgcatgctttaataaaacttatagcggtatatctggaattaattttactgaatcagacaagttctttctccatatttttaagttttttctgatttcatcattttctaaggatagaatagatgctgccattatggctgcattgtatcctcctgatgatcctatggacattgttgctacaggtatacctttaggcatttgtactattgatagtaaactatctattccatttaaattactactttttacgggtactcctatgactggtatgtgtgttaaggatgctactaaccctggtaaatgagctgctcctcctgctcctgctataataactttaaaaccattgtcttctgcagattttgcaaatgtataaagcctttctggtgttctgtgagcagatatgatcattacttcatgagttatgtttagctcttttagtattgatattgagttgttcattgttgaaaaatctgattgacttcccataataacagcaacatctgcaatgtttttattggttgacatgatatttctctataatatctttaatggttgactttaactgtgatacactatttatattagttattgggttcatcccattgtacaaaactgctatatatgggatgtgatgatcaaaagttatacctttattagttaaatgtgacaatagttttttcatatgatttggtggtacattatatggagtaaaatatagagtaccttgtttagataagaaggataacaacttatttttattttcatctaacgagataataataggatgaatattttcattattagcaatgactttgttaatttctggaagcttttttatacaactgctacaccaagatgtataaattactaaaatatttacctttgaatctttgattgtgaacatctcagataatgctttgtctgaatttatttctttgatttgtaatagcgtatctggcatattacgttgtatttgatagtaggaagatatcttgttgatagtaagtagaataaataaaaaaataatacaagtaaaaaatataaagtgtttgttattcataaaatttacctatttgtgtttttatgggttctttaacaggtacttagagtgttactatatattgtgttgttgcttactaaaagataattttaacctgtagggattatttttaagctgtagtttaaagtagtttaatgtctttgtaaatttgtaaattaaatagatgtaaattaaaatagtcatgtaagaaagttaatgataagtggtgtatttttgtatgctgttataattttttgcatatgtgttgaatatatttagaatatagtcttgaacttttaatctaatgatatagaataaaaagcattaaattttaagttatttataatatgactcaaactcttactaaatcgaagatagcagaagttattaatagagatgtagggttatctcgtgaggatgcttcgtctgttgttggggagattttggatgaaatgctgaatgcattggtaaaagatcgtatacttaaaatatcttcttttgggacttttaagtcttataaaaagaaggctcgtatgggtcgtaatccaaaaacttctgaggaatttgttattaaagagcgttatactgtgtcattttacccatcaatacttattaagcattcaattaatagtgatgatagtacagagtagaggtaaaattcatgggtgaaaagaaaatattacacgatgaatatagtagtaagcttaaaacaataggtgaggttgcaaaagacctggatgttgaacaatatgtactaaggttttgggaagaaaaatttcctcaggttaatccaattaaacgtcgtggtagaagattgtattcacaagttgatgttgatactttaaagcatattaagcatttattgtatgataagggatataagattaaaggtgtgcagcaagaattaggtaggaaacctgctaatattaataaacacactaatgatacagaacaaagtgtttatagaaaagatttaattagtttgctagatgatatgttaagcttaagggatagtttgttaaagaagtttaacggaatgtagcgcagcctggtttagcgtgtcagtctgggggactggaggtcgtgggttcaaatcccatcattccgaccaattaactctgtctttaatactatatgatctttagttcatattataagtggtacatgtgaagttatgttgataatatggttgtatacttgtaattttaattactttgttagttataaacgtgatttatataagtagttagtaataatgttctgaatataatggcatttatctaatatggtgtgtgcacaggtgttatagtatttttttgaagtgggttatttaataacattgttaaaatacattacagtttttatttagggttttttgaatacaagttataggtattataaaaagtaggggatacgtttaactacatataagaaggtgcggatggagtgggattcgaacccacggtacgctattaacgtacgtcagttttcaagactggtgccttaaaccgctcggccatccatccaatttatttgtaacataatattaaaaatcgtgcaatatctctttagtttgattgttaaaaattaagaatagtacaatatgttaatgagataatattaaatgagaaaaaacaggtaatggtatcacaaataaattatttagctaataataatgtttctttttttgtgcagggaaagttgatttaaaacaaaattaatacactaaattgtataattagagcatgctattttactaatggttattgtatgcttcatttaacaacagaaattaatgatattgatttctctaataatttaaatatttatagtgggaatagatttgttgttacaagtggtgacatgcaggttgatgttggaagtgaacctgatcatggttatcatattttatttaaaaacaatggtcatgttatatcagattttcgtggtgtacaagctgaaaactttgtatttgatataaaaaatcacaatttaagagcttctttcttagttgatcctatggcaccttttacagaattagataacagtcagcatccacacttcgtcgttaacatgcacactgcaaatgaatgtggttctgattgtgttcatcacaatgaacatgatcatgatgcacacggaagaggtgcggctagctctgtagctgaaggtgtaggttctgcaataagtcaaatcttatctttaagtgacagtatagtggttccagttcttgaaggaaatgctagtgtatctgaaggagatgcagtagtaaatgctgtaagccaagaagctcctgcagctagtgtatctgaaggagatgcagtagtaaatgctgtaagccaagaaactcctgcagctagtgtatctgaaggagatgcagtagtaaatgctgtaagccaagaaactcctgcagctagtgtatctgaaggagatgcagtagtaaatgctgtaagccaagaaactcctgcagctagtgtatctgaaggagatgcagtagtaaatgctgtaagccaagaaactcctgcagctagtgtatctgaaggagatgcagtagtaaatgctgtaagccaagaaactcctgcagctagtgtatctgaaggagatgcagtagtaaatgctgtaagccaagaaactcctgcaactcaaccacaatctagagattctttgttaaatgaagaagatatggctgctcaatttggtaatagatacttttatttctaaataaacccataatatagcatgttaatgctataaaactgtaaactgataatcaaggtttagcttctgtggtgatagaagttaaaccttggtatgttaataaaaacgttatagtcttataagtatactatttttgtatttatgtataatgtcaagtgatgatttaatcttttagttaatgaatacactttcttatttactttcattattacttgtattaattctaggaaataatactgtattatttgtatgatgaacttgaaattagagttttagtacatttcactttataagttttactgatattttttatcacgttgtgccttaagattataaagtataaagatagaaagttaagcattatgaatttaaaggttattcatctttttagattagttatcgttgtaaaaagcgatcttacaaatacactaagtttgtaatgataagttttgttttttatatagcagacggaaaccttataaactgttaactagtaatctgccaattttaagacgttaattaaaatcaggatattggccatcagataaaaattacacctgatagtgaatatagcacagtacatacttagcaacttttgttactagtagtaatgtgctgtattaaaattggttttttggttgattgatatatacctcactagcaatgctaggcatcatgttaaatagtaaatgacgtagtagtgtataaattaatcttttgctaacaaagtattatgattatgaccaacaccctatgatttcttttatttctaatatgtgcttattagcaatagatgctgctttattgttacctgatactattatgttatgaagatgttctttatcttcaaggaattctgttactttatgtcgtattggagcgatattatcaatgagtaattctgttaattgttccttgaattgttttgtactgaaattttcaatgttagtgcatgcttgttctatattgatgtttaaaagtgtagcatatatgctaacaaggtttttaacttcaggcctactatctaaagtactaaaattgaatcctactatagaatcagtggttgctttgcttattttttttgaaattacatcgttactatcatataagttaatacgagtgtaatccgatgagtcagatttactcatttttttctttccattcctcagattcataatctttgctgactcctgcataatcaatggttctgggatttgaaaatattgcgtgttatatgtagaattaaaattcatagcaatatccctagttagctcgagatgttgtttttggtcaatacctactggtacaatatttgctttgtatattaatatatccgcagccattaatactggatagctgtatagacctaaacaagctgttgatactttgttacggcttttttctttaaattgagtcattctatttaattgccctgttgaagtaatacaactaaatatccataacaattctgcatgtgcatggatggatgattgaacgaataaaactgatttatttgggtcaataccacatgctaaatatgttgctaatgtgtttatagaattttgctttaattcagctgaattataattattagatgttaaggtatgtaaatcagcaagaaaaaaaaagcacttatatgaactttgcaaagacacccaattacgtatagaacctaagtagtttccaagatgtataccaccgcttggttgtataccagataaaacaataggtatagacataattattatcctcaaataattggtggtgtattttacaataacttatctgattatgcacgtactttctacactgcaaaaacacgtaatatacaactgatattagtatgtgtcagaatagtagagagatgaatgtatgagagtttaattaaattatatctagtcactctttttagatataattactgaagctgcacgtaataatttgtcttttattatatacccaggttgtacaacatgtaagatggtgttgtcatctttttctgcgtcgaccatttgggatacagctttgtgaaactgaggattaaacttttctccgattgggtctattctagtgatgttgtgacgttctagagtgtttaacagttctttatatgtcatcagtactcctgcatgaatactgtcaccctcctttaagttttttaatgatgtttctaagttgtcacaagagcttaataaatcacgagcaaagttagaaattgcatatatggaagtatcatctatatttttttgcatgatgcgtttaacattttctttatcagcaactgctaaacggaattgattctggaaatgtattaattgttgtcttagcttgtctagttctgacaaatcttcgttcaatttttctttcttcttgtttattcctgctgtaaattttctttgtggattgacttgaggttgaccaggttgaaccttgccgtcagacttttcattgggttgagggttgttatgctgtggactttttgtattgttgtcaccattatcactcataattctgaacttgtttataaactctaagaaatatatagtaacattatgaaaaaatatcaagagttataagctttgttagtgtggtttttctgtgttgttaatattttatgatacgttacgataagaaatttatgtctttagcattaaggattgcaagacgtggtcttggtaatgtatttcctaatccggctgttggatgtattgtggtgaatcatggaatggtggtaggacgtggatatacacaagttggtggtaggccacatgcagaagttattgcattaaataatgctgggcatttagcaaaaggttctactgtatatgtaactcttgagccatgctcccattatgggcaaacaggcccttgtgcattaaagttaatagatgctggtgttaaacggatggtaatagctgctaaggatcctgatgtgcgtgtttctggaaatggtatagaattattacgtaatgcgggtatagatgtaaagtgtggtgtcatgtatgaagaggcacgagaattaaatattggttttttttatagtaaaatcaagaatagaccttttattacagtgaagttagcatctactttagatgggaaaatagcgttaaaagatggtaatagtcgatggattacaaatgagttaactcgtaattgggtacataaacagcgttctatgtatgatgcaattatggttggtagtaatactattgttcaagataatccaatgcttaatactaggcttcctggtttagagtgttattctccagtaaggatagtaattgatcgttttggtaaagtttgtgactatcataatatcataaaaacttctgatgttatccctacgtatattttgacaaatgatgttcctcaaacaaagttgggtaaagccagttgtttagtagttgatgataaagataattttttaagaagtgcgatgaaaatgctttctgtaaaaataggtattactcggttatttgttgaaggaggtggtgttttaattacagaattgcttaaaaatcagttgattgatagaattatatggtgtagatcaaataaaatttttggcaatgatgcaataccatctattggtgatttggatatcttgacactacagtgtggttataatttcagagcagtagatacattatattttaaggatgatattgtagaaattttagagcattgtaccgaataaaccgaataaatatactttaactgtgacatcttagtttaatagaactttatatttatatatgattaatatataatgataatggtatgtggttataactgcttattagttgatcatgtacctgtgtgttatgttaaatagggtataaatatgtcacaattctctgaagataatatgggtaatatacaaatgccttttgattctgattcacatgagccttctcatcttgagctacctagtctttctgaagaagtgattcaattagagagtgatctacaacaatcttctaattctgatttacacgggtctttttctgttgagttatttgatccttttaaagaagcagttcaattggggaatgatctacaacaatcttctgattctgatttacacgggtctttttctgttgagttatttgatccttctaaagaagaagttcaattggagagtgatctacaacaatcttctaattctgatttacacgagtcttcttttgttgagttacctggtccttccaaagaagaagttcaattcgaagatgatgctaaaaatgtagtatatggacaagaccatgttagtttatctgaattaggcttattgttaggtggtgtttttagtacaatgaattatttgtctggttatacaccgtattattatcatcattattgttgttataatccttattattattttgattatgttactccagattattgtcatcactgtagtgaaagtagtttagagtaggatatttagaaatataaatggttgttgacttcacaaaaggtgtagttttatatgttttatgctgttttatagtgttataaggatatgagttgtttttactatttttctctataacgtttcagtctttaaaaaacatgacttaatataaagcagcataagtattttagagagtaacttttttatagtagttgtttttttacttttatgtgagatctataattttaatgttttagttatagattgtatgatttgatgtgtagatcagtattttaatcgctttataattttttagttctgaaaataagaaactgctgtactgcatttataaatttttttctaataactgaatacaattttagttaatgatatagatgtgtagaaaaagaaatttcattaaatactaaagctcaatagactatgtaattctgaagttgactattcttttttagtctaatgaagctttgatgaatgatataaacaatggatgagaatgaaaaggacttgatttaaattctggatggaactgtactccgataaaccatggatgatctttcagttctataacttctattaaactatcattgttattatttgatttgcctgtaaagattaacccatgttgttcgagtaaatctttatactgtaaattaaatgcatatctatgtcttcttctctcatgtattattgattgctgatatatggaaaagattttagaacctgattctaaataacatggacatgaacctaatttcatgcttccgcctaagaaattttgctgtaattctggcaattggtgtattacaggattcttgcaatataagttaaattctgtggaattagcatcttctaaatgtgccacattatttgcaaattcaattatagcaagctgcattcccatacaaatacctagaaatggtatcttattgagacgtgcataggttattgctgtcatctttccttgaatcccatcatcaccaaatcctccaggtattaatatagaatcaactttgtcgaaaatatttatctcattactatctagtgaacgtgaatctatccattttattgataactttaccttgttatggattgatgcatgttctagagcttcaattaatgacttataagcatcaagtagttttatgtactttcctattattgctacatttactgtttttgttactgcgtgagaaatatttagtatattttcccacttacgtagatctggttcaggtgaatcaatattaaaatggtttaatatctgtgtgtctaaattgtagttgtgataagagatagggagttcatatatatttttaacgtctaatgcaggaataatatttgttgatgaaacgttgcataaatttgcgatcttatctctttgttcttttgataaaggtattttactacgatagagtattatatctggttgtatgcctacagaacttagttctttcacagagtgttgggtaggctttgtttttagttccattgctgcgtcaatgtatggaactaaagttaaatgaacaaatatagtgttatttttactgagtttgtaaccaatttgtcttatagattcaagaaatggctggctttcaatatcccctacagttccacctatttcgcatataacgaaatctaatttatcagtatcatgtaaaatgaaagaattaatgagatcggtaacatgagggatgatctgtactgtttgtcctagataatctcctcttctttctttctttagcaaattatgatataccttaccagtagttatgttatcgtttttcgttgttttaactccagtaaaacgttcatagtgccctaaatctaagtctgtttctgctccatcatcagtaacaaaaacttcaccatgttgaattggactcattgttccaggatctatgttgagataagggtctaacttccttaaacaaatcttaaaccctctagcttgtaatagtgcacctatactagctgcagctaatccttttcctagagaagataccacacctccagtaacaaagataaacctagttgaagcttgattcatataccttactgattaaatggtacgctatcttcattattatgttccatagggggtaggttatgtgccttactcatctcggcaatttttttaacaatagactccttgtgtacgcttttagcgtttatgcccactaatagaactgtgttgataataaaagcagtagcaataataactgtgagttttgtaataaaattagaagatgatccagttgtaaacattgagtctaaattactttgtgtgcttccaaacccacttaagttgtcagattctggtggttgtaataatataagaatcaccaagaaaaatactaagactaattgtataactgttaaaaccatatagaaacaataacgctattaagtacatacataattgggttatacattgtttattgtttaaagtcaaggattgcagaagttataaaaaatataatttttatactaacaaattaaaaatggatgcttattaattgaatttttatagagtacagtatgtctgatttgcagattttaactgagcatgtatttattcttgtagagaattaataatcatgaagagattgttgcattatttgtaatagcaatagatttgttatgtgttagaattcgaggatatgcaaatgattagttagtatggataatcaaagatatgtaaatatttttcttgaagcgatagtagcagaaaaacatgtatctcataatacttatcagagttacaggactgatttactgggactctgcaaatttattgatagaaatgaccttttgttgacagatgctagtatacacgaactgcaagattatattaggtttttgtatgagaagggatataaagcaaatactgtatcgaggaaaatatcagctattaaaaatttatatgggtttttatatagagacaatatcattgagaatgatcctactgtgtatttggattctcctaaattgtcccgttctcttccgaaaacgttaagttatgaagaagtaaatatattacttgatgttgctgctttagatgtttcacctgatggaagaaggattaatgctattgttaatatattatattcttcaggtatacggatttctgagttagtgtatttgaaattccgtgaagtgagagaagctttagatgatggtgatacagaaatatgtcacatgaaaattcaagggaaagcaaaaaaagagaggataatattgttaaattcatctgctgtaacaagtatacaaaaatatatggaagtttatgaatattttattccaaatggatataagatgtcacagtggttgtttcctggtacaaagtttgataatcctgtaacaagacaaagggtaggtcaattactaaagaatttagctatgaatgctggtatcaatgttactcatgtttctcctcataaacttcgacattcttttgcgacacatttgttgaataatggatcagatattgtttttattcaaaagatgttaggacatgctaatctagcaactacacaaatatacactcatgttgcgagtgaaagattaaagagtatactactaaaatttcatcctttacgtaataaataagggtgtatgcatattttaatgatataagcaaattatttgtattgctataagagttgttggtttagttaaagttggcgaatttggaatggtatagaaagttggcgaatttggattatagtattgcatagattgaacaatatattacatgtataagcttgtgtttttggtgtagacatatagattttcgcattcaagtgcagtttgagataaatagtttaaaagccataaaagattagtgaaagttagaagtattacttctagaaatttatttgttatgtttaattgatctgtacagtgataaaggtattaatttttatatacttagaaatgtcagtcctattatattttgttgaagcctgattcatcaatgctataacttctcagtatacctgaatctattttaacgatacgacatgctttttgagctaggctgtagttatgtgttgcaaggagtatagcaatatttttttcttttgcatattcttgtagcaaagaaaatacttcaagtgcagtattgttatctagactaccagttggttcgtctgctagaactatcagaggacaattgattaagcttcttgctattgcaacgcgttgtctttctcctccagaaagctgtgatattggcattgacaatttatcttgtagtcttacgcgttctaaaatttccatagcatttttttttgcaatggacttacttttacctgtaatgatttgtggtaacatcacgttttctaatactgaaaactcctgtagtaaatgatgaaattggtaaatgaatcctagaaaatggcgacgtaaatatgttttatctttgtctgaggttttatctgtgcactctatattattgagcaatatactccctgaagatggagtgtctagtaatccagcaatgtgtaataatgtacttttgcctgatcctgatttacctattaaagcaacaatttctcctttttttatttgtaaagttgcatttactataactggtacttctttattcctaccaaaagatttgtaaatattagctagagcaaatactgtagacatctttcatccttttgcagttttaatgatattagcatgtatatgttgttaaaactatatctgtttataagaaagtcatatattgtaaaatttttttaaataatgtgagtgttgtgtaaattgtatgatgaatagcgaggtttttatgtatatctgtggaattatggatatggctagtatgtatttataaagattaataatgtatcatgatgtttgttaaaagcttgacatagcgtgttatctggcagtatacaagtgaggctttaatagaagtgtttattgagtatgttttatggtagatcttgaaaataacggttttgatgaaaagagaaaagaagctcttgaattccattgtaaggatttaaaacctggaaaagtttctctgttacccactaaacctctattaacacaaagagacttatcattagcatattctcctggtgttgcagtaccttgtttagaaatagctagaaatcctgatttagtatatgaatatactgcgcgaggaaattatgttgctgtcatttcaaatggtacagctgtgcttggattaggtaatatagggcctttagcatctaaacctgttatggaaggtaaagctgttttatttaaacggtttgctgatattgatgcagtggatatagaagttaacacttctgatgtagatgaatttgttaatactgtaaaatatttgggactaagttggggaggcataaatttagaagatataaaagctcctgagtgttttattattgaaaaaagattgagtgaaataatggatattccagtgttccatgatgatcaacatggaactgctattattgtggctgctggacttattaatgctcttgatattacaggtaaaagttttaaagatgttaaaatagttataaatggtgctggtgctgcaggtattgcatgtcttgaaatgataaagttaataggagttcctgctgagaatataactttatgtgaccaaaatggggtaatatataaaggtagacaacttggcatgaatgagtggaaagaaaagcatgcgattgaaacagaaaataggtctttgaaagatgcattgataatggctgatgtatttcttgggttatcagttaaggatgtgttgagtaaagatatgctgttgtctatgaacagagatcctgtcatttttgctctagcaaatccagatcctgaaattaatcctaatgttgcacatgagattcgacctgatgctattatagctacgggaagatcagattataataatcagattaataatgtaatgggattcccttatatatttcgtggtgcgttagatgtacgtgctaaatcagttaacaatgagatgaaaatagctgcagcaaatgcaattgctatgttagcgcgtgaatatgttagtgatgaagtgtctgatgcatatggtggtcgtaaaatgaattatgggaaggattatattatacctactccatttgatcctagattaattactgtagtatctcctgcagttgcaaaagctgctattgattctggagttgctagaaaaaatatagagaattgggatgaatatactaaacagttagcatcacgactatcattgacttctaatatccttagtatgatgtacagtgctgttaaatgtgatcctaaaagagttattttttcggaaggagaagaagaaaaagttattgaggctgctgtacagtggcgtaatcaagaatatggattacctatacttgtagggcgtatcgacaaagtgcaagaagcatttgaccgtttaggtattaaagatacaaaaggtatagagattgctaatgcagcaatttctcaacgaaataatgagtatacagactatttatataagaaattacagcgtgaaggatatttatacaggagttgtgtacgagatgtaaaaacagatcgtaatgtttttgctgcgtgtatgcttgcatgtggtgatggtgatgtgttgattactggaatgacaagggggtattatgcttctattaatgatgtacagaaagtcataggttctcaaggtgtcgtatttggattatcaataattgttatgaaggagcgtactatatttgttgcagatactgctatacatgaatctccaactccagagcaaattgctgagatagcaattcaggcatctgttcaagctaagaaaatggggtatgaacctcgtgttagctttatttcttcttcaaactttggtagtcattctcaagaagatgctaagaaaatgagacaagctataaaaattttggatagttataatgttagctttgaatatgatggagaaatgtctgttgatactgcgcttaatccagagttgttaacattataccctttctgtaagttaactggtgaagcaaatgttttagtgatgccaactcttcatagtgctagtatatcttctaagttattacagagggctgctggagtatctgtaataggtcctattttaattggaatggaaaagcctgtacaaattgtacaaatgtcttcttctgtgtctgagattcttaatcttactgtacttgcatctttagtgaataatactaatttttaatcttcttgtaaataattgcgtgtatataagattatgaatttgtattaatatatataactgtattaattatttattaagcatcgctatttattgggttatactttccctgatatttttatacatgattaatattatttatgataaacaaatagtagatgtttttttggttcgtcgatgagacttttgatatattctggtgggacaattttagtatttttattatttttaataatttctcctttttttattaattggaattcttattatgcgtctcatgtgcttaaacaaatagaggatatatcaggtgatgtatctgtaaagggtgtggggaaagttaccgggagattaatcttacctaaaattgtgatcaataatttatatatagaaggtcatggcaacgaattattaaatcataaatcaacaatattaattagccgacttgaattaaagatatcattgttatctttattactgttttctcctaaagttaatgcaattactatagatgggttaaatattccattaggtaatcttcttgatctattttcttcatttcaatctaaaaattttaatataaaaacgtttaatgtttttaatagtgttgttaatacaagttatgatggtacatcttttaatagtaagcctatatccattaaaagtggaactataaaaacagttagtgatatgaaggtaataaatggtttattaagtatcggtaaaaatgattataatgtagttgctgatatatcattaaatgaagagcatagaattaatgcaaatatttattctcaatcaacaaaggtaactttgtctggtgtagctgctggtaatgcatttgatggtgtgatattaactaatgggagtgatttttcacagtttattaatgatatttctgagaccaataaaacttctatcttttctttcattaattctcatgaagagttttctttatccactaatataaaattattagataaaacttttgaattaaatgatttcaaattgtctactgatagtatggaggggataggaaaagtaatctgttcaaattatgcatcatgtagtgctaatattgatttttcgagaattgatgtggaccgtttgtatggagttaaacatgaaagtgatgtttatagaaaagattctcgtacccttgactacttgaatacattaatatctgaaaatttaaactataacattaaagctagtgctaaagaaataaagtaccatgatcaagtctctagtaatttaataatggatttagaagtatccaagggaaaaattagcatcaatcaaatgacaattatgttacctggtaataataatgtattacatgttgaaggtaatgttggcagtaatgatttgatttctagttttcatggaaaactgaagataaatggggatgacttttgttcttttgctaagtggttatttccaatacaagttgaatcgaaatctagtgataaattttctatacaaagtgatttatacgtagctcctagagtattttctttatctcatattgaagtattaactgacagttttggagacgtaaaagggcaattaaggataaagtatgataggaaaggtagtgctgttgttggggatatagaaatacataatattgattttgatcagtacaagataaatgaaaaattgaaaatagaagactttatgccgatgaaatggttaaaggacataaagtataaaataaatgttgatactaatattagtgattttattattcaaaaacagcaggtgagtaatctaagctttttagttaatgtaatgcaaagtaagtttgccattgataaaatacgctttaatggtgctgatggatctgatcttagtggatttattaaagcttacattggatctcaggatctaaagccaaaaatattagttagtcttaagggtaataagtataatactgcattcataaaatttccttctttgatacgttatgtccttgatggatcaaataaagtcactaatataaaatggtcaaatgaagatctaaaattttatggattagagcatgtagatggtaatattgatattaatattaaaaattttatttctaaagataattcattaaaggactttgtattatcatctagtttaaaagataatttaatgtctgttaacaaacttatgtttaaggtagatgatgggtttgtatcagctagtggtaaaataggtatgggttctaatacttattcattatctgctgttctgtctatagccaatattggattgaataatttgcttaagcatataaatgttgatggaattactggaaatgtaagtattagtggtagtgttcaaacccagggtaagactttagttgattggattaatgctttagatggtaaaatggaagtagttgctaagggtgtgaatgttgttggagtagattttaataaatttattataagtttattagatgttcagagtaaatcagatgttgctgcgttaactcagattggattgtatgaaaataatacagtatttaattttattagtgctggagctaatataagaaggggtaatattatatcttccttgcaatttgcaattgacaatgctagtggcatggcatctgcaaatatttctttattacagtttgctgtgatgtctaaaattaggttatcatttatacgtcctaatgtgtcttctccatctaatgtagatatgtcattaaatggtcaattatggcaacctaggataaattttaatgtaaatgctctgtatgaagagattgtgaagggaggtagtcaatctgtttcggcacatgatgaagagtttatagattaaagttgcataattatataggaaataatagttcatacattgaagcatgcctttttgttaatgttagaaatactaaggttttgttttgacagattatttgtggcttattggaaccttggtagattgatatatatatttattatagttggggcagaagttaacttaggatgtgaatttagataatataaatcttaataagactaatattaacattatcggtatagcgaattgaatggtaatgaatttgttcaaatgtttagaatatatagtaccttcacttatatggtagggtaagtatgaatcaatgataccttctgtcattataggtaaagagttgataattcttccgtaactatctattactgcagaaataccattatttgctgctcttatagtaggaagcccgttttcaatacttcttacacggttaatttctaagtgttgataaggttgagaacttataccgaaccagccatcatttgtaatattaataatccattgtccttttgtacacctacttgtaacttcgttactgaaaatagattcataacatattaatggtataaaagggctttgattatttagtgatatagacttttctttgtttgttccaggactataattaagcctatttgcaatacttttagggattagattttttaatatagatggtataaattctccaaatggtactagatgtagtttatcatagaaatctattatttgaccattatcattaataacaaataatgtgttgtgaaacttattgttttcaaatcttgtacctccagcaattaaaaatcctggtataataaatttaagataattttgtactgatctactgtttgtgtctgttaaaaaggggaaagaattttctccccaaactacatgtgttcttgaatttaatccatatttactggttaagcgtagatatgtttgaaatctatcatactcctgctcttcatttccgtcccaatgactttcagtatttccttgtactatacgtatagctatcttctgattatatttctgttcttggttatttgataggcgatcatttccataaatgaacatgcttactaatattaatagtgcagtgatacatggaagggtactcttgtctcttatagacactccagcagctgtactacagaatatggcaagaaactccatgccatatgttccaattaatgaagcagtttgcaacatttctatggagaaagaccaagaatatgcaaatagattccaaggtactatatatcctaacaacatgctggcaatagtgaaagacagtgagaaagttattaaaccgaataatttcttgtaattaagcgtataactaatagctgcagctgcagcaaataataatgataaagatgctgaaaggatgagggtaagaggtattagtggccaaaaaattttgctttggataattagtggaacattaacccagtatgagctggctgtaaaatatccaaaaccaaaccaccatccacagaagaaagcttgtcttgtatttttgacttgtgataatacaatgtaaaatccagaaaatgctattagtaaagcaataaacatatggaaaggtgccatagatatagcgcctgcaactcctaatatcattgctaaagtatagttatattttctgtaaaaatctccttctatcaactcgcttgccctacattaacattcaactgtaccaagtaaagactagtacgctgactattgtaaatattttttatgttatgtaaagcataagactttataatttattttcaggatccttatgattttttataaattgaaaagcttagtatttgagtcttgaatgttggtgagataattaaatgggtctgtgaattcattatgaacaagtttttattattaaggtttggtgttaaggcctatagtgcgaagttggagtagactatattgttcgctagtgccattggagtatatgtaagaattatacaatttaatataaatatggtttatatatttaaagtagcaaagtatttctttaatattcttatttatataggacatattgtaatgttagtttttttgtatctgttgttttgaatgataaactaacatattaaaggtagagaccaataatttattacattttttatgtaaatcaattaattattgctattttacaataaaggcgcttgcctttttggtaatattttagtaggtttgtcaatcatatattattgaatttatgggtatatgtgatgattagttcgttacctgttttacaggttgttatacctttactttctgcgataggatgtgcattgttaaaagatgctagattagtcaagattatatcagctattgtagtgttaatatcttccgctattgcagtagtgctattttttcaagtatatcatggtggtgttattaaatatagcataggagggtggatagtaccttatggaatagaacttaaggtaaatgtctttaattcgatgatgcttgttttagttgggtttgttgctatgatgagtattgtatatggtatctaccctaataccaaagaaataaatgtacgtacaataccaagtttttattctgtatttttgttatgttttagtggctttttaggaatattagtttcaaatgatgtttttaatatttatgtttttctagaaatatcatcaatttcttcatatatcttagttgcaatgggtaataacaggaatgcattgatagctgcatttgattacttagtaataggtaccattggtgcaacgttttatttaataggagtagggtttttatatgctattactggaactttaaatgttggaaatttgtttttaatagttcaagataaatctttaacgacaaatagggctatacaagttgggttgttgttcataatgttaggtttgtttattaaagcagcactatttccatttcataaatggttaattcaagcatataattatgcacctacttttatttcggtattcttctctggtgtttctactaaagtaatgatctaccttataataaaagtaatatatgatgtttttaaagctgaattagtactgttaactttaccttttaatattgtatttatgagttttgctgcattatcagtgatttctgcatctattcttgcaatgctgagtagtaatatgaagagaatttttgcatactcaagtgtagcacatctaggatatattatatttgctgtaggtttgaatacttactatggtttagtggctgctgtaacttatataattaaccatagtttagtgaaatcagcattatttatggtcatgggtagtatttcttacaattgtggtagtcttgagcttaaagattgtacaaatatttggaaaaatatgccaaagattgcgttaccatttgttattttatgtataagccttattggaatgccaataacttcaggatttatttctaagtggtatgtttttgatgcggcaattaaaacgaatttttggttgggtgtaattgttttacttataggatcaggtctatctgtggtgtatgtgtggaatataatagaagcaacatgttttaagccatctgataaacaagtgaagaaattgtttgaagttcctaatgttatggtgttatgtatttgggtaatggctatttcatctattattcttgggttatatccagtacctttaatgatgatttctaataaaatagcggaatcactgttatattaaattagtgggtaaagtttttggtgcatttgtaatttttggaagggataccttgatatatttttcgtgaattgacttttatatcttcaaggtatttaataaaaatcctgttacttaaattcctgcaaaccattgaacaaccacaatttttacttttgttttcttctcaaataaagcagcagctttattaaaattaaagtaaatttgtttagatattatacaattattcatttttaaaagattgtactaaacaataatttaatattttagtgaaaaattaattatctgcttcttccttgcattttgctttcgaatacttgagatactgattcaacaacaaaaaagttgcttccttgactgtgttgagtactgtgctctggtatgtaatttttattatgtggcttaggtgtaaaggtactactactactattgttgttcgtgtatgatgtcgttgattttttgtatttagatttactttttttacgtttaaataagtaagctatacctgctaacaacactaatacaagtaaagcagtatactttggattattaataatataagataaaatataatcaaaataactcataaccatattactttgttaatacacacttctttaataataacattaagcaattgttttgaatagtaatttaatgagaaaaataataaataattcttgtcttgtattagaaatatgtacaatatgtgatttcagttaaaaataaatttttattagttgaaatagtgttattcaacaaatttgtttgctaattttgtaagaattacattcaataagcaattgttttaaatagtaatccaatagagaatataataaataatttttatattgtaaaaaacatatacaatataagattttagttaaaaataaatttttattagttgaaatagtgttatttaacaaatttgttcactagttttgtaagtattacattcaaatttaagtctgaacttgtgtgttcaataaatccttccacaggaataacatcttcatttgatcctagggcaatatcaatatgtcttctccctagtaggttagagagagataatgatgctgaactatctgagggtaatagaatattcttttgtatacacattgtaactgtaggactataatttttgtcgagtgatattgacgttactgtgcctattttgactccggataatgttatatcgtctcctatatctaatccgtctacacttggaaaatgtgctttgactatatagcaattatgtgaagtagtgttaagaggtagtttcttaaatgctataattccaatagatactgcagctactagaacaataagtcctgcgaaaatttcaattacattagatcgacgcataaaactaccaatgatgtttgacgttattttgtattataaaaactaaaagttttatttggatggtaagcatattgagttccagttaagtttggaaggtgtaaactttgtgaagattttggcacctgattatctgcataatgtagccatatatgccacggtgcaggaacttttgttggatctgctttaccattatatattacccaccttttttcaattccatttgctgttgtaatatagtaacgattacctaaaatatccttaccaactaatttcttattcctttttactaggaattgtagattgagaaagagtttcatattttaataattggtaatttattttacatcagtataatagttatggtaatacaatacaactattaactagatatttagttaatattttatgtaataattagcttaaagtgataatatgtaagtaattatgaaatgtcctttttgtaatagtactgatactcaagttaaagattcaaggtctatagaaaatgacatgttgattagaagaagaagagtatgtcttgtatgtcactctaggtttacaacaactgaaaaattacttcttagatcgtttatggttgtaaaaaaaaatggtgaaactgaactatttaataaacaaaagttactttcttcgattttgatagcgacaaaaaaacgtcctgtaagtcatgaagggataaatatgatggtgaataatattttttatgagcttgaaggaaaaaaagaaaatgctattccgactaatgttattggaaaaatggttatggataatctttttaagttagataaagtagcatatgttagatttgcttctgtatatatgaattttagaaatataaatgactttagtaatataattgcgaaaataattagtgaaaagactccttaatgcatctcaataattatattatgattgattattattcttgaattgttaataagcttgtgctatgtattttggaggttatttagtagtaacgttatctcgctgtggttctatgggggtatagctcacttggtagagcgtctgctttgcacgcagaaggcaagcggttcgattccgcttacctccactttcctgttttaaaagataagatcgcatttttagtaagtttattattttcaataaaataaataactactataaatcctaatgttacctattttatgcactacagaaatattctattgtactaacccgaaatcataattgtcgataaatatgtggttattttgattaatatagacattatcattttcttgttcttttccatagtctttaaagatattgttgtatgcactccatacttgatcataactgtaattttcttttatagcttcatagaagtttagccatccttcatatgtcaaatcaaaagatatgtgatgtttatcctgatctatgttatcacctatattaatgtgttcttttgatagtggaaaatatatagtatcaatatcttgctctgtaataggatcaaaggtattaccttcattggtatgatgttctttatctatcaacttttctggtcttgtgttatcttctttttgatctaaaacgttgtgttcttgtattgtttcacttgcttgatgtgttatgtctcttgcagagatgttgtgtgtttcattctgagaataatctagtggtaaaatagttgataagtactctgttagtcctgtatttggaagatcaagaatatgatttccttgtttgtcggaaaaatatgtttgggtgtgatctccttcatcagatttaatagtaatataaatattggttgagtctagtttctcttgtgagattgctgcaaaagatttagtaaatccagaaatgggttcatcgtacttaaagacttctctaacattattgcaatattcaaaggaaaagtttccatcaaagaaaagatgtgtattatcatcattaggaattaatgctatttctttatcttctagtattacgctggcaaaatttttgccatattctgtttgtaaatcgctcttcacaactttgaaaataaatttctcatgcatatttacgtagcgattgtcattcggtatgtcttgtatttgaaaattagcaaaatttaacactcttaatgctgtattataatcttttactaatgatccctcttgttctatatctgtaaagaagaattttccgtcttgtattacaagaaaaattggagaattttccatttcctcttggattacatcatctctgatattgtgtaagtgaatgcttttatcatcattgatgtggtgtttactaatatcagaatagttaaatatgaaagtatcatgatttgcagaagagtaatgtttgtattgtagagattctggacttaattttgcaaacttttcattagaatgtaagtctaaaagtatagcaggagatgtttctgtgtttttgtatggttcttctgaggatattttaaatagtgggctgtctcctctggtcttttgtacattgtaatattcttctaagtttattgtttccggtttttcaattatgttttctggtctaatatagaatttttgataattataatggtatgcttctccattttgatcacatatgactaagttgtaaaaatcttgagtttctttactgtatgtagtgtattgtgtacgttctacttttatgtattggtattcagaaggtatgttaagatagctgtcatgtaggtaattgttgtatggaacataaaatttatcacctacaaagaagtaattttttgatggcataactatttcagtattatcttcagttgttattttaacagtgtatatattcctgttacaaaaaccgtgtaaattttctcctacttttaatttaaaagaagatgcttggtttgttgtgattggtatgttgttgttcatattccctctcttaataattattaaatattttatataattattacttaattataatttttatgttgtaaaaaacattaattaataaattcattaatatttttagataaaaatgtcaatatattatatctaaaaagcaatcaataagttaatttattaacttttttatattgacattttaacatatcttgtgtatgataccgatctaaattaatatttattaacaaatgaattatatgacagtttttttcgaatataatggcagtaaagttaacactaaggaagtagtgaaacgcaatactgcaggtagaacagatcaagataaggactcttctacctatgtatataatacttataacgctggtgatctacaagggcatgtacaacagtcctttatgagaaataatgctgagcacaatagaacagatactgttcttccttataatgatagttatgagactctacctgttgtgcctgctgtagaaactggtgctgatggtaattcaggtaagggtaattctgtagattttaaatctaatgttttttgtaatacgcatactataagagacgatcagttgaaattaaatctagaaatacacactttaggaaatttatctgatagaagattacaggagattaagaaaggatttgatgattcaataataagatttaaagataattttgggttggaacccaatgaaaaagatactacttttgaattatatctttttgatgataaagaacaatatgagcattatggacggctttataatctaggaataaatggagctggtggtatgactttttatggagatgctgatgttccttataaaatttatgtatatcagtttggtgaaatattaaatttaaaacatgagttaactcatgctttagagaattatgcgtctggacactcattgtctaagcttaaaataaatcatgatatatttacagaagggttggctgactatatacaaaatgatggtacttttattatgagagaattaagagataaagaagtaacatcaagtgtattgaaggagggttcttctaaagatatagatcaagtcagtgatgctgcagtagctaaggatcagcatttgagttatagtataggacacgcatttgtaacatttttacaggagaattatcctggtgtgatttcagagtactttgcagcattgagggaaggtaatgctgtgcatgctagagaaataattagcatgaataagtatgcagattttgaaccgtgggtacagtctaaagacatttctttgtatctagaaggcatgaatgtattaaagatagatttaggagaaaaaatgttttctgctaaaaacgctgtttcttttgaaaataagaatgtaagaaatgaatattactgtgaaaacatttgtactatgaacggtgaagtagtagggaaaatatctcctgtggtgcattatgccgataaggatactattcgtacttggaatattgcgagtactgatatgatagaagtaaaaccagagtatagttttctaaaattggttagtactccatctggtaagtctgcatatgtatattgtgataaggatggtaatgagtattttaatactcaatcttatgtggaatatgcgtttaatatcttgaaaaaatatgatgagaatcttcgtatcaatggtgattttttagatattagaggtcgttactcagatgctgataaagtgtttgataaaattcctaacgcagatttgttgttggatcagttcttagataaaattggttatggaaattataagcaagtaataatgagcgacccagagcaggttagtgttataaaaatgcatatagtaaaaaaagcttttgaagattttagagaatctgaagtcaaaaaagtgtttactggtgaatcaggtgttgattctacaataaaaaatctattgatggatttaacttatattaatttaagtgatgtgataggagtaaatggttctaatattgaaagcattgtatctgatccaaatgtaatgttgcgtactgctatattaggtaagggagatgcaagtggaatatctctgtatgtaggtgatcaaaaagtcgctgaattatctactgaaggaggttattgtgtgaaggatcttgatactaataatgtgaattttgtattccgcaatgctgttggaaacatagcaagtagttatcaagatagagcatacatggttgtatgtgaaaaagatggtgaatttactactgctctaattgatgatatacaaaagacagagcatggaaatgttatatgggataatcagtttaatcatcctggtgttaatcatttatatccaaattatcaaaaggtattattaaatgatgcttcacttaaggattattcccatcttgctaatacaaggtttcatcatgatgatacagtaattgtacggggagatctgttggatgacaaaggaactgttacaacgagtgatgacattcatcaagcagtgattaaacatgatgatcaagtactacatcaatttaaaagtatttctttttacataagtgagccatcaacagatagtgctggaacttatggtagtgatttctttattgctgatgaagggaaaaatcttagatttcaacttcctaaaacaattactcatttaaagttagtaaatgttgatgggaatcaaaaattagtaccatgtactgcagatggtaatgagcaccctgatggtatgccatctaatttaacagatgagtatcgatatattgatcctatttttgctcacacatttgagaaacaaagctattctaaaaatagtgttagcattggtttggtagattttgataaatatcaagaaggaactatgtttaaattacagtattattctgatgattatcatattaataaggatgaacatggtaatataattagacctaataatgtgtcttataaaacaaaagttgacctggtatatgatgataaagttattggaatgttatctgataatgtaaataaatttcagggagatgtttttgttgctgcaagccttaattatagccacagtgattttctttcgtctaaatattttcagaaggtcaatattgaagcgttagaaaatggggtatatagtggaagatatgatgtaggaagtggtgatgaaatagccaatcttgatactgatgtaggttatagtgacaaaactgttttttattttaaaggaagtaattcacctgttgatgtattagataatgttgatactgtgtctactatttcaccttatattaatgagtttcaatagattttaaaaaagaagcagcgttcaatgaatgctgctttcttgtatgtgtagagtcatttttccgtgtgtatatttcactataaatgaattttatatgacgttgtgaataattctacgattttacattgcatgtatagttttggtagattaaaaaagtagtgttttatatagattatgaaaacgttttttaatgtatatttggttattttcatagtgttttatatgaatatttttatacgtttttaatttatgaaaagtatatttataattataagtgtgctttaaagtagttctataattatatcaatattgcatttattctgttgtcttgtataatagtagggttttgaatatttatggattaaaacgatatgatgagattaattgcttgtcttggtattatagctgttgttatcctagcctttagtttttttactaaaaagcagcaggttcaagatttaacacaagaagtacgagtatattcatctcgcaaggaagaattattacatagtttgtttaaacaatttactaaagaaactggtataaatgttaaatacatcaatgacgaagccgctcaacttattaatagaatggaaaatgagggtactgctacttcagctgatgtatttttaactgcagatgctgttaatcttattcttgctaaaaagaaaggattgttgcaacctgttcaatctgaagtgttgaatcaagcaattcctagtaagtatagagatagtgaggggttttggtttgggttaactaagcgtgcaagggtgatagtatataacaaagatttagttgaaaagagtgacttaagtacatatgagcaccttgcaaatacaaaatggaaagataaaattttagtaagatcttctagcagtccatataaccagtctttaattgcttttatgatagcaaataatggtatagaaaatactaagatttgggttaaaggtttagtttcaaatatggctaggaagcctagtggtggggatatagatcaaatttatgctgttgcagcagatgaaggtagtatagctatagttaatagttattattttggtaggattgcagcttctgataagaagagtgatcagattgcagttaaaaaacttggtatctttttccctaatcaggaaaccacaggtactatgattaacattagtggtggtgctgtaacaaagaatgcaaagaataagcagaatgctataagattgttagagtttttaactagcgtgaaagcacaaaaggtctatgctcaagttaatcaagaatatcctgttgtagaaggggtagagctctcagagattttagggacttttggttcatttaaggagagcaatttgcctttacaagaattagagaaacatttgactgaagctgttaaaatggcagatgagtgtgggtggagatagtttttgaataaattgaattctgtatataagtttacttcttagtctagtgtttattagagttaatttattatcaaaaagttctttacgtcatacagagcttttattaaaaggttatattttagtttcttgtacattaacttgattagggtaggtttttacatactgtatgtttcttaatgattattgggtattattaaaacatgtatttctgtatgctcgctatgggggctgaaatcttttatgatactgtatttgtgacctgtttggttattaagataatgagctttttgttgcataacctatatttgctgctaatctcggtcaaaatattattacttcctatatttattatggattccttagtttcttaatatcaaattttagttattttattgtaagagctgtggtttttatttatttagttggggctatagcatttttatttattggtaggaagagaaaattatttaatttatcgtccatttattagtcttatgcagtaaaccgtaatacttatatgcttacttgcactttagaattatttgcttaatctttgtacaaccattttgattggtgttatccaaatttacctatatggctttgtaataatagcttgctgcttgtcttatttacctattaattatttagggctgtaatacgtcacaaaataccaaaaaataacacctattagcaagacaaacagatatttgtttagtctgcttaatctttgtacgaccattttgattggtgttatctaaatttacctatatgctttgtaataacagcttactgttttttatttacctattaattatttagggctgtaatacgtcacaaaataccaaaaaataacacctattaagcaaggcaaacagatatttacttagtctgcttaatctttgtacaaccttttgattagtgttatccaaatttacctatatgctttgtaataatagcttactgcttgtcttatttacctgttaattatctagggctgtaatacgtcacaaaataccaaaaaataacacctattaagcaaggcaaatagatatttgctgtctgcttaatctttgtaaccttttgattagtgttatctaaatttactgtatgctttgtaataacagcttactgttttttatttacctgttaattattatataaggctataatacgtccaaaatactaaaaaataacacctattagaaagagaagcaaaaaggaagaaagacctgcactataaacattactcttattaaaaagcacattatatgtagtaaaaaccgtagcgttaaaagtacactaagctgtttctatattaataatacctttctttataaaccaggatattctgtcagttgcttgtgcaccaacacttaaccaatactttaatctatcaaccttgactttaacaaacagttcatgctctttagggagcattggattgtaaaaacctaaagattcaatgaacttcccatctcttgcaaccctagaatcagcaacaactactctataaaaaggacgcttttttgctccaaaccttgctaaccttatctttacagacatgagaatataacctttaaaatatgttgaatactttcaaatcatacacataatagtatggtgagtcaaattgaaaaatgcatttttaaatatttaaaatcttatctttaagttctttgaggaaaataagaaatttgcaatatgttgttaaaagcaatatgattaattagtcaagcttgttcaaattatgaaaaagtgaaaagatgtcctttttgaaaaggatatgtaataggaggatatttaagttatatgaatttaagaagagctgtgttatcgacaatcatgtgtaatactttagtatggtatgattatgtgttatttgggaatttggtgagtgtaatcagtaaattattttttccagcagaagatagatattttagtcttattatgacattcagtatttttgcagttggatttttaatgcgtccttttggggcaagtatttttggttacattggcgataaatatggaagaaaagctgcactgactttatcgattatagcaatatctgtccctattacttttatctcaatattgcctacctatgaaaaaataggaatattgtctcctatattacttattatttgtaggttgatgcaggggatatctctaggtggagaagctggtaatgctactttcttaatagagcattctaaaaagggaaaaaacattggtttttttggtagttttgagacccttagtgctgtgcttggttctattattgcattatttatgatcttgttatctcagtactttacaggagaaaattttgaagtatggggttggagaataccttttgtaattggtttattattgggattaattagtgtttatattaggcgtattactggtgaaagtcctgcgtatgatactcataaagaaaataataatctttctcaatctcctttcttagaattgttaaaaaagtataagcgccctttagtcttggcaacatgtattgactgtgtagaaaattgttcatttcatatttttatggtgttttttattacatttattaaggagttctcaaatattcacctgaatttaaatgctaatactataagcattattgaaagttttaatataatgatttgtggtattttgaatgtattttttggatatatttcagattatgtagggcgtagaaaagtaatgttaattgcatctgtgtcattgttttgtgttgcaataccagtattttggttattaagtcaagatagctatgtttctttgattgctgcatatttaatatttgtaattccgttttctgcaactttaggtccagcaagtggtgcaatgtctgaattgttccctacaaaagttagatatactggttttggattatcgcgtaacattgcttcagctatatctggtggtatggctcctgtagtatgtacatggcttataagggcaacagggctttcgtttattcctggagtatatgttatgttttgggcattggttggagttattgcattgtgtcagatcagaaaaaaagatgtttatgctgattggtaatctactatttaaatgttgtgcattgatctaatgtagtagctaaaatgatattctcactagaatgaatagggtttttgcgtggatattttgttatatctggttttaaggtggttgtttagtgatattgcattaagtgtgaaatgtgtacagctattataaattttgattggtgttatctaaatttactatatgctttatggatggcaacctactgcttgtcttatctagctattaattattataggggccataatacgtcacaaaatactaaaaaataacgcctattaagaaagacgaacagaaaggaaggagaaaacctgcgctataaacattaagtgtatatacaactttattaatttgatgttatacagctctgtaatcagtagaggaatcactcttctagttttctggcttcatcgatcagcataattggaatgccatcacgtattggaaatgctaatttggctttttcactaattaactcgttagtgtctttattatattgtaacttgtcttttgttaatggacaaacgagtatttcaagtattctatggtcaaacatatttgacaataaagtaaagttagttgattagattataacatttattatgaaaacatgaactgtagatttttttaatgtagtaaattgttaaaaatatgggtctgtagttggtgtgtttttaagttttataagaagcttaataaacttataaaagacacatgatgtattattaaataacctaatactataggcctttatttggatgttattgtaatatgttacatttaaagtgcaaaaagctatttataccataacaagggtttctaattattgtataaaatttacagtgccagtttcattgttgttatcatctaatagttctgctattctggtaaggatagtcttaacttctatgttatccattatattatgatggtttatgttatctagaaagtggtgaggaatcattttggggccaatagcattgacttttatttttggtgataattctacagctgtaaattttgttaaatctagtagtgatttttttgacattgtgtatataaaatattttgtactatctttcgtaatcattgcatcaatcatattaataacatttcctgtagtggtacatttttttgcgaaatattgcgttaaaaatagaggagcacgtatgtgcaaattatagtgatcagtaaaatctttaatagaggtattcatcagtgtgtttttgtagaacactgaagcactgttaataatgcaattacaatagggcatgaattcaaaagtcttatctattataggacttagtgaatcaaattctattaaatcagcttgtatgagaatgcacttttggtggtataattcttcaatagtattttttgtttgtaacgcatgtgcttcagaaatgttataatgaatggctatatcatatccattgttagctaagaacattgctattgctttgcctaacctacgtgcaccgcctgtaattaatgctccttttttatgtgttttcaacatgatacgagatgggtaaaacaaaaaccataatgatttaaccattgtaatttgttactatagaatttacgcaggtcgctaatattatatttgagcatggcaactctttcaataccaatgccaaatgcaaatccactatattgatctggatcaatatttacatttgttaaaacgttacggtggaccattccacatcctaaaatttctatccaatctttttccccacactttatatcaacttctgctgatggttcagtaaatggaaaatagctattacgaaatcttatttggatattttctccaaaaaatttttttaaaaagtaatgtatacaatattttaggtgtcccatattaacatttttatcaatatataaaccttcaatttgatgaaacattggactatgggttgcatcccagtcattcctataaaccttcccgggggcaataattttaattggataatttcctttgttagcttgcattactctgatttgtacagaagatgtatgagttcgtagcacaactcttttttgatttactaatgtttttaaataaaaagtgtcattttcttctcttgctggatggtttttatgtgtattaagtgcatcaaaaacgtgaaattcatcctcaagttctggtccatcagataatttaaaccctaaagatgaaaaaatatgtcttacttcatgtaaagttttagaaatcggatgtaatttagctatttgtttcgggcgaactggcaaactaatatcaaccctatcttgcatcaattgagcattgatttgtattttatgtaatttttctttttgagaattaattaaagattttagttcagcacatatagcatttacactacttccaacagatttcctctcttctatattactaattgttgcaatactttttaaacatgctgttatagtgcctgacttaccaaagtagtaaagctttatgctttctaactcttcaagggaagagctagatagtatcttgttagtagcttctgcttgtaagttgtatatattactgtgcaacacgagatttatttaaagcttctttaataagatctacaatttgcttgaagtgatccttatggttaaccgccatgtctgctagaactttcctattcaatgttacatttgctaaggataaaccgtgaatgaagtctgaatacagaagaccatgttgccttacagctgcattaatacgcataatccacaggcttctgaaaaacctcttacgattacgtctatcacgataagcgtattgtaatgctttttctactctttgcaaagctatcctatagcagttcttggaacgtcccctataaccttttgctagcttaataaccttcttatgccgtgctcttgtcgtaacaccacgcttaactctagccattcttaacctctatctattaatactcctacctgctataaggcataaaaagtttaactatacgtgaatcagaagaattcataatagcagtaccacgttgaacgcgaatactccttttacttcttttagtcataccatgtctttttgcagattgagtagactttattttacctgttgctgtaacactaaatctctttttaacagaagacttagtttttaactttggcatctctatcctaaaatttttgcagaaagttacatcttaatctattcgctttcagagtgtcaagtacattttctaaattttactctaaataatttatacactgtatgttaatagtttttataatatggtgtactaaaatttagatgaaaaatatttctcgattaaaataacctgctacattattattcttcacgatttattaagtttgttgaaagtattacataagttattgcaaaatttatggcaataatttataagtgatacacatgcattagtagtaatgtattattaatatttatattttatttatttttgtgaatacatggttatttagttatattgagaatttggagaaatctgtatgtcaaatagtaatgttcctttagctcataaccctaaggaatcttcttccacgttagaagactctggtcctttaatgcctagggctgttgcggtatggttagtagataatactatattgacttttgagcaaatagcaaaattttgtaacttgcacctgttagaagttaaaggtattgcggatggtgaagttgctaaaggtgtggttggatgtaatccaattacaatgggacaggttacaaaggaagaaattgaatattgtcagaatgatcctactagagtacctagattaattagctatagaaattttaaaaaaagtaaaaaaaggactgttaggtatacacctgtagcacgtcgtagagataagcctgatgctgtggcatggattttaaaatattgtcctgaaatgcaagatgtatgtatagctaagttgataggtactacgaaatcaactattgctgctattagaaataaagaacattggaattcgagtaacattaaacctagagatcctgtgttacttggtttgtgtactcaagtggatctagatgaagcgattatgaaagctcagatagttgcagaaagagaaagaagagtgaaaaacatcaaggctaatgatttttctgtgtctgattcagtgtaaaattgttgtgttaataaatctttacttaacgagagtaactgctataatttaacatggtatatcttcctttaagtgttactgttatactatctagatagtacaaatcattacgtttactaaaataccaaagtgttgttgttttataatcagtgatgtttattaggctgttttgccttatgttttaattgaagtatatttttgttagctttatgtgttgttaagttagtgttaattggtgaataaaattatcatagagtttcagaaattaatgttgcatttgttaaatgcttaagtattaattttttaatattgcgactaagcatatttgtgattttttgtattgatttaaattataggtgtatagtgttaaatgggaaaaagaagagagtaaggtatgttagcaaaaaaaatgctaataagagtgcaggaatgcagcccgtgacaggtgttgtacagaaagaagaagagaaagaagtagtagaggtacaagaggaaataatagaagagaaagaagaagagaaagtaccagaacaacaagaagtaaaagtgttagatctgagtgagctaaaaaagaagacaatagaagatttgttgaaaatagcagaagaccttggagtggttagtaatggtagaatgctgaaacaagaaataatatttcacttaatgaaaaaagtagtaagtgatggaggtgcagcaataggaggaggggtagtagagatattatctgatggttttggattcttaaggtctcctgaagcaaattatgctgcaagtggtgatgatgtatatatttctgcaggacaaataaaaaagtttaatttaagaacaggtgatatagtaagtggtgaaataagagcgccaagtgagaaagaaaggtattttacgttagtaaaagcacatagtataaactttacagatatggcaaagttacaaagatatgtacactttgatgatttaatacctttgtatccagaagaaagaatattattagaatgtaatgatcctatcagcgtgagtaaaaaagatataagcatgagagtaatagatatagttgctccattaggtaaaggacaaagagcgctgatagttgctccaccaagagcaggaaaaacaataatattacaacaaatagcacattcaatatctgtaaatcatccagatatagaattgatagttttacttataggtgaaagaccagaagaagtgacagatatgtgtagatctgtgaaaggagaggtagtaagttctacatttgatgaacctggatatagacatgtacaacttgcagaaattgtaatagaaaaagcaaaaagaatggtagaacataaaaagaatgtagtgatattacttgattcaattacaagattagcaagagcatataattcagtaataccgtcatcaggaaaagtattaactggtggagtagattctaatgctttacaaagaccaaaaagattttttggagcggcaagaaatatagagaatggaggatcattgacaataatagcaacggcactgattgaaacagggtcaaaaatggatgaagtgatatttgaagaatttaaaggtacaggaaattgtgaaataatattagatagaaaaatatctgataaaagagtatatccagcaatagatatttcaaaatctggtacaaggaaagaagatatgttgatagatagtgtgtgtttgaagaaagtatggttattaagaaggctattgtcatcgatgggatctgttgaagcaatggaatttttaagggataaattgttgataaccaaagacaataatgaattctttgatatgatgaatagttaatatgggtatagaaaataagaactttataatgaatgtataagcgaaatacttataactgtagaactatatgtagctatttaataaaaagaatgaatgttgtataattagtggtattttaagagaaatccctttgattctatatttgtgacttgtgtttttgtagattgcttaattgtgaaacctatgatgtatagtcactgcttaattattacaagaaaatagttcagagttaattgtgtttatgacaaaagagataccaaactgtacttatgtttttgatatgggatacattgctgttcaaatgaggtaattgggaacttgtgatgtagtctgtatatttttatgaaaggaataaatttacagtatatgatgagttatttgatgctaaggatttacattaaaatcatcgtgatttaattgtggattgcagtggtacaatgttaggaaataggaaaaaagttgttaggagttgtagtactggtgatgctaaatgaaaaatgtgttaagaccttgtatcctgttttgttaatttaataacgtgtcacgtgcttcatttaatttttgtgctagataaggagatcctcccttgtctggatgcatggatttcatgagcttatgataagctgtgttaatctgttcttggcttgcatttttatctagtcctaatatttctaatgcttctcctctagataagctactacttgtgttttgtggactattatatacatttgcgtcatttataactttatttaaagtagaggtcattatttcactaatacttattatgctatttctttttaatagtagaagtataagcaatgcaacaattggcaatacaaatataacgcctattatagagaatattactagaaagataaaccacatataaatgacttgatttaagtaaggtatctacatattatacaagttaaaagtatttttttgcaaatggtttattatgtttatacaaattggggagactccaaatcctaatactttaaaatttatgccaggtatgcctattaataatggtaaggttagtgaatttgctgatagtgtggcagctgaaggttcttctcttgcaacagcattattcaaaattgaatatgtaaaaagtgtattttttggaggtgatttcgtttcagtaacaaaatctgatgatattgagtgggatgttttgaaaccagaaattttgacagtaattatggaatttctaacacttaattcggataatgctactgaaagttttgatcaggaagaactggaagagttttttgatgaaaaagatattgaaatggttggtaaaattaaagagttaatagataattatgtaaaacctgctgttatccaagatggtggagatataaagtttaaaggatacagtaatggtattgtttttgtaaaattgagaggagcatgttcagggtgtccaagtgcctcaattactctgaaagaaggtatatataatatgttgagctattatattccggatatacaaggtgtagagagtattcagtagaaatagaatatattagttttgctgttgtgttggaaagtactttttaagtttttaagtctataagattatctgtataagcgtttaattctactagcggtaactttgcaggggatgggttcatttattatatactaaaaaatgtttatttgatgtttttatgtagataaagcttatgtagtgagtctattgtatttacataatctacatggttagtttgttttattatataagtgttgcaatttgttatagttaaagttcatgtatgaagggctttaattctatttgtaataacctgttggtaatggttgtttttgatatcctgaaagcactgatgaaagttctatgtttggtatataagatgtgttgtagtatggagttctaatagaaacgatattaaattttgctatatttatttcaaatttaccattaatgaagaaatattttttataagatatgtttttaatagtacatctatagtatttgttaagagtattgagatatgacttttgaatatacaatgaatgatagaattatgaaagatctgcattttttagaataagtctggtatacacttaagtcctaacattgtttaatactgtattttatactagagactagtggaggtgctaggctgagtatgtgtagattttatggaagatgttgaatcaagaaacgtaaagtttgttgaaggagtgataagtttttcatatgattttgtttttttgtgacgtattacctttcttagtttgtttttaattgattttgtagagtttttagcaatgtgcaatatggctttttttgtgttttttataatgttgcttttgcgtgatttattgtgtcctgttgttatgggttctcttattgtatatgaagtacttggtaaatgttgttttgttgtgtttctggtaggatatataacatgttcatgttttatataaaacttcatattgctgacaaactctttaatagtcattgtatcttgtgcagatggttccatattacttagggatcttattgttatcttaatgtctttatagtaaggattccacgatatattagtattgtgacgtattatttgtaattgtttgaagaaaagtgtagtatcaccataggctatactttctgtaaatgcgttttctatttgttttataatctctgttttttttgtaatccttggtttaacaatataaatatggataatttgcttaagtttgttaattattgaataccatggatatggatgtcttaaaagtttttctgttttgttctgatgatcttttaattttattcttgtattgataagcttgttctgtattgaaaaaacaatatgttgtttaggaaaaaggttaagtgctgtttttggatttatcggtggtattttcattatatgttgatataagtatctgatttgttgagatattggtatattaggataattgttactatacggtccagtgattccatgacatgctattagtaaagttgcatctggattgttcatagctgatgttatttcgcttgttatttcctttattatttcccttgtgtacattgttaaacttgacatatcaagtgcatatgatcggaaaaattcctttagttctggatttatatctgatttgagaattatttttctaaatgttttaaaaagtgtatctttagtttgttgggtgatgcttatatttttgaaattactaaataatttatttaatgctttgtctataattttttgatcttcagggaatattattactctatctgagattttattgattagttccttgaaccatagttttagtaagagtctagctttttttttgtcttgtatagttttatgtgatgtattagtgtaaaattgtatgatgctatggtagcggtaattctcattatcagctgtaggaacatcacagacttctggtactattactaataatagttttaaaggatcagttgatagtatttcgaatatttcatttcttaatcgtgaatgtgtactgtattttctgactttatgtttacttttaggcattgtttaatagtaataaatatattaagtatccaatatcatgaattaatttatttgttaagttatatttataatagtataaataagttaatttattattctaaggaaaaaatttattgatgttgttaagtcttgatattctttgaaatgttgaataagtgataatttagaaatactatcatgagtttttgaaataatatttattaatgtaattttgatgatatatattgtaatactttttagatttttaaaattcaagtatgagtgatgtattaattactgttgttgtgaatcagaaaaaaatgttgtttaaaccaggactaacacttagtgaagttttaaatgagtgtaattatgatactgatttaccatttgctgttgcagtgaataggagtttagtagtaagaaataaatatgacagtacttacttaaatgatgaagatattgtagatatagtgtatcccatgcaaggtggataaagattagtgtccttatttaatattatgaagtgtcgattatactttacttaagcaagaataaattaattgtgtgatatgtatgttgttgagtcgaagaatttattgatgttaagaagaattttgggtgtaaacatagttagttttgatggagaaaataagaatatatgttgaatttgtatggtgtattattaaaaagtaggctcctgttgggttctgctatgtatccatctcctgctattttgcgtgaatcaattcaactgtctggtactgaagtagtaacagtatctttatctaggcaaatgccatctgaaaatggtggtagtgatttttggaatatagtaaaaaaaagtggatgtcgtattttacctaatactgctggatgttgtacagtaaatgatgctgtacttatgtctcaaatggcaagggaaatttttggtactaattgggtgaaattagagctaataggagatgagtatactctatatccggatttagtattattatgtgaagctacaaaggagttaattagtcagggatttgaagtatttccttattgtacagatgatctagttgtttgtaagaaattggtaaattatggatgtcgtgtgttaatgccaggaatatctccaataggttctggatgtggtgtactcaatatgtacaatttaaagttattaagaaatagatttccagaaataacaattatagctgatgctggtataggtaggccatctgatgcagctatgataatggagattggctttgatgctgtgctgcttaatactgctattgcgaaatctattgttcctcaagatatgtctcgtgcttttaaatatgctgtggaggctggacgtatagcttatgattctggaattattcctaaaaaagactttgctgtatctagtacaccactgattgatacacctttttggtataacacttctagttaaatattgtaaaattgacgtttttgtttatatgttgcagcatttattagtaatagtgcttagttagatcaagaaattggcatatttaaatcaatgtttataataatacttgagaatatatgtaggtattttgttataaaatcatacattataaagagtagattaatattgaggtggagtatagtttagtattattcattattatgtgatgttttactatattatgtaggcttttgaatgtacctatctcttaaactttagttttgcggaaattaggttttctgcaaatataacatcgtgtatcttatatcccatttttttcaattttgcttgataccaatcgggataagatgaagctatataaagtgaatatagcaaattcactgataagtaaattggtaagttaataaggtttagtgtgttgtacattatataaattccactaagtatcacaattgaaataaatgataaaagccacagcttgttgtaaaatgtgaaaagaattgaaaatataaatgccataaatgagaactcgtcttgcacaaacactatgccatctgaagtattaattttctttgggtgtttatatataatgaaagattgcatataaattatatagtttgctgctctacatttaatagtatgattaaaatagaagttagtaaacctaaaagtattgcaatgcttttttaagttagtaaatttaaaatatttttgtatagctatataaaaactgtgtacgatgttatcagaattttgtgtaatatgtagcatttaaaaatagagtattagtgatttgattgtgtcaattaatttatcttgttcatattatttatttgtgtagtgttgaattttaggagatcttggttatgattacacgttttgctccgagtccgacaggatatcttcatgttggaaatgttagaacggctttagtttgttggttatatgctcgtaagcaaaatggtaagtttttgttaaggtttgatgatactgatactcagaggtcgaaagacgagtatataagggaaatagagaatgatttagtgtggttaaatataaattgggactctagttttagacagtcttctagatttgaccgctatgaggatgtgtttaattatctgttgaaggaagggttgatatatccttgctatgaaagcaaagaagaactcgaatttaaaaggaaaatgaaattaaagttaggtttaccgcctatttacgatagaagtgcattgaatctaactcaagcggaaaaagataagtattctgaaagagctccatattttagatttaaaatagatcagaatcagttaataagctggaatgatgaggtacgtggtaaagtatcatttaactcagagaatattagcgatccaatcattaggagggttgatggaacatatacttatatgctgccatctataatagatgacatggattttaatgttactcacataatacgaggggaagatcatataagtaatacagcagttcaaatacaaatgttacatgctttgaaagctagtatacctatattttcgcatttgtctttactgtattctgatgataataaaatatctaaaagagttggtggttctagtgtgaaagatatgcaatcttatgggttagaacctatggctattaatagttattttgctaaaataggtacttctaatccagttagtgtacacacgagaatgtgtgggttaatagattcttttgatattactacttttagtcaagctccaactaaatttaatatagatgatgtattaaaattaaatcccaaggtattatgtagtatgtcttttgatgatgtaagaaataggttacagtcatttaatataacttctccaagtttttggaattttgtatgtgggaatatagacaaattctctgatattgaaggatgggcaaaaatttgtagtggggatatgatacctgtgattgggcaagatgataaagattttatcatgttagcactaaatatgctccctcagggagaagtacgtgataatacttggaatctgtggatttctaatataaagcagcatactgatcgtagagctaaaaatttatttactcctttacggttagcgttgactggattatctacaggtccagagcttgcaaagttattgcctttgattggtagggtggaaattgtacgtagacttagttattctgaagtacaataaattattttattactgagtgtcttaatataatgtatttctatgttgtatttgatcatttattgtgataaaagtaagagatatttctttaattcgatggcgggtgtagctcagttggtagagcgtcagtttgtggcactgaaggtcgccagttcaatcctggtcattcgcccatagctttttagtggtttataaactgcactcttgattataaaagtacttttgtgctaaagaatgtgtgtgtagttttatatttagaaagtttagaaatagtgtctttacgtctactatgttattgtatatagtcgctttttaaattgttcaaatttttgcttagggtttttatcattagtgatctaactaatatgtttatttttaagccagttactattttccttatagaagtgttactctgttaaagagtctttgacattgttgtatttttatataaagttgattaagtaacttattaaatacaattcatatgtttaatcatgcagtaaggttgttggtcttatttattattttatatagtagtaatgtttttgctagtgtaaagatagtagctatggtgaatgatgaattaatttctaacttagatttagaaaagcgtattgctataaataagtttttttataaagttgaaggtaatacagcagaggaaatagctttaaatgctttgattgatgaatctatatggaggcaagaagctagaaaacttaaagttacagttactgaaagagatcttttagaagctattaaacagtttttagtgataaaaaatttaggtaatattgatttaaagtcttatgttgaagcacaagggttagattataagttgtttgtacaacatatgaaatctaagctgctttggaataaaatattaatgcttaaaatagcgccttatattattattagtgataaggaagtacaagatagtagggataatatggtgggtaatggactagatatatctgtgcatattcaagaagtaatgctaccagctagcatgaatgacaatgagtctataataagtagtattattagtgagttacaaagtggagtaagtgttgaaactataaaagctaataggaaagatgtgttgtttgaagaagcaagtgttaatgttaaaaatattgatgcgaatttagcaaataagttacttaatgctaagattggggatgtgataggtcctatgaagagtgagtatgggactttaattataaagttgatacataggtctgatataaacaaagagtttgcaaatagtaatgttgatttaaggcaaatgcatttaaatattgagcagggtaaggagtatttggatcaaattagtatattaaaaactaaagctacgtgtgaaaattttaatagtgtagcaaaagagcttggattacctgagccgttaagttttgtaataaaagtgaaagatttatctgtaaaaatacagaatgttttacaatcttgtgatgttgggaaggtagttgaagtgactgataataacgtagttgacgttattatgttatgtaatgttacaaaaggtaaagctgatgatgtggtagataatgctgattttatcaaacaaaggctatacatggaaaaattgtctatgcaaagtgaatatttattatctactttaaaaaagaatgctttaatagaaaaatataattaattgtcatgttacgtataacgtcagggaaatatcgtggtaggagaatattttctgataaactgcttagtgctcgtcctgctatgtctataattagagagtctatttttaatataatattatctcgcatgagtattcaagggtgtaaaattcttgatttgttttgtggtagtggatcattatcgtttgaggcattatctagaggtgcagagagtgtgttattggttgatataaaccactataacttaagtctagtaaaacgaacatctgagtatttgggagtagtaaataatgtaactcttatgtgttgtgatgtcgaaaaattacctcttgcaactgatcaatatgatattgtttttgttgatcctccatataccaatcctaatttagttgatatgactcttaatgtactaataaaattaaactgggtgaaaagcagtagtatagttgtagttagaatcagaaagaaagtggtttttgtatgtcctataggatatagaataatggttgagcgtacttatggtatttcaaaagtaataatgctgcaacgtgagttttagatggttatattaatatagtttattgaactgctatacagagctttatgcttattgtgtatgggttgcaagtttgtaattttaagcatgactattggtataacttgttcatataaatagtactaaaatcattagtataattaatagtgtgtcaatcaacatgtaatatacatctatattatttagggttgtagataatatttatatgcttactattgttggtaacatattacaattgttagtatatatcttgtaatatggtatagtatttagtaattgatattgaataatggtgtaattgtttagcgtgcatctaatattacatactagtgttaatatatatacttttgatcttatactgtataaaacttctgtatttttataatattaatagatataaacatctgtgtatattctttaatacagtagtattgaaatcattattgggacatagaatagtcctataattgtatttactaataacatgattgctgttttatcagggttattgtttaacatcgtagctaatattatacctgtacctgacattgggattattgcgagtaatattagtgctctatatatatcattgttatataattgtatggttaatttgtctaatataatgcacccaagtactaacactggccacagtacatattttattattaaggtaatagaaatcaatttccagtcgatggagaaagttttaatgtttgcaactgctatccctaataacatcattcccaatgaaacgtaagcacctctaatattacttgcaacatcatgtacaaatgaaggaataggtattttaaagtagttgacacataatgccattacagctgcatgtgctgcaggtgatgttattagttttattatgcatttttttggagtatatattccttgagcagcaatgtaaaaaccaaaactgttttcaaacattaacatacctacataacagaaaaggtatatggatactgtgtgattatcaaacattgctaatgctactggtagtccgaaaaaacccatacttgaactacctgagctaaatgctagtatatttcttgtgctatctctgaatatgaaagaagaagtatagtatactacagctgacatgatacaacagacaagccatgttaaaaaaggaagagataggacttctgagttaatgtttgtttgtgaaattccagaaaatataacggttggacccattatgtaaaaaagcaatctagctatgctaggactatctattttgagaaatttgccagcgataaaccctaaaagtactgttatatataaaggtaaaattttagatagtaatataaaaaacataatttttgtagcatgctattagtgtatgaaatactgtaacataagtgtgaattactttacaactatagaatcatgaaaaatgtgtttataagtaaaattttagttgtcaagtataggtcatttatttagtaacataataaagggtatataaggataaatggagtaaaatagtagttaataattttcttattattgcaagttgtgtgggaactataggaaagtataagtatagtaattttctgaggtttgtcttatcttttattcatattgtatttttatacaggatgatacccttttatagatcagtatgcgtaaatgatttgttgtgttgtactgatgttatttattaagtaataatttacttatttcttgatttgttttctagtggtggactattataagctgattgtgttaatttgaaatcttattacttgagctttagcttgtacattttatagtcgatgtttatagtgtgaaaatagggttaacttcttcttacatatctctgggttttgtaaaattatcagcgtaagattttggaactatggtgcgtgggttatcttgtaaaacagtataatcaattttatgtgctactgcatatgcaattgctagttctctagttgtaaatgataggcagacctgttgtttagtatcatgtgacccagtccagttcattagtggttcggtgtattgagtgcatgaaggttcaaattcaagtttccacgcttttaacttactatgaccagattgcatggtactttttgctggtttatatattctagcacgcacgttcgacacttgttcttgcataaaaaaactattattatgttaaatatatacagtaaatagtaacttatgtctattaatgatgagtataattttgaagctgctatagagcaactagaatatatagttaaagaattggaatctgacgaagtaactttggctagaagtgttgaattatatagtcttggtaaagaactgtatgagtattgtaataaaatcattgaggatatagaactgaagatagaaatcaaggaataaggacaaggaggaataaggatatgtctctaattctgttatgtatgtaactatgtttgtgttgttataataaaaatagtgtatgcctaattatcatgaatttaatttgtgagtataatgctttagtgtgtttagaaaattaattagaacttcttaaagttatatcaagtatcttgtataagaaaaaatttcttgttgtattaaactataaaaaaatttgtgttttaaaaatattagaacattggatgttgtattggttctatttggaatatgtgtcatcaatgatagtttataggttttttaggatagattttactttgataggacttcctgttattataaatgatgaaatttgtagaaaagctactcatttgttacattgttaaattagttattgctagatgcaaggtttatggtgcttttggttatttaattaatgtttctatagagtaaatagtaatttattttagggataattggcaaaaaaaatagcaattaatacgtatttgttagttgtcttgatttttaattagaagatatcatagttatatagggtatgctggttgatatgagttagagagtcgtaatgagtgacgtaattacctttggatgtagattaaatttttatgaaagtgaagttataaaaaataacttaaaaaaggctcagttggatgatgttatagttgttcatagttgtgctgtaactaatgaagctgaacgtcaagtaaggtctaggatacgtaaactttatagagataatgctaatgttaaaattattgtagcaggctgtgctgttcaattaaatcctgagttatatgttaatatgccaggagtaattaaggtattaggtaatcaggataaacttaaatatgagagttatcttgctaaggataaaattattgtaagtaagatagagaattcaaaagaagttgtgcaagattcagttaaaggattttctggcaaatctagagcattaattgaaattcaaaatggatgtaatcatgaatgtactttttgtgtaattacaaaggcaagaggtaataaccgttctctatatatagaagacattatcactaaagttaaagcttgtgttgataatgggtataatgaagttgtgtttactggggtagatataagtgattttggattagatatttatggacaacgtgttcttgggacaatgataaaaagagtattgagtgccgttccacagttgcgtagattgagattatcatccatagatgtagcagaaatagaggatgatcttattaatattattattaatgagcctagatttatgccacacttacatctaagcttacaatcaggaaataatttaatccttaaaagaatgaagcgtagacatagtagagagcaggtaatagagttttgtaataaaataactagtaaaaggaaagaagtagtatttggggctgatattatagtaggattccctacggaaactgaagagatgtttaatgatacagtgagattgatagaagaagcaaatatttcttatctacatgtttttccatattcaaagagagaaggtaccccagctgctagaatgccacaagttgtacaagaagtgaagaaaagacgtgtaaaacacttattagagtttgctgagaaaagattgcatgatttttatagtactctgttacatacaaagcaaagtgttgtagttgaaaagtcaggaactggtagagcagaaaattttgctttggtgaaatttttggatgataatgttcaattgcaaagtattgttgaagtggaaataaaaagagtagaaggcaattatttagtaggtcaggtatttgtttagtaatgtctaattttaaaactaaagcttctaaatgtatactgtgctaattctttttttgtgtgtctataaaaataaaacttaattttattgtgatgaagctttgatgaaagcttattagtagaatctaaatttatacattgatataattgttatattttaaagctaagtaggtattgaaaattataagaatataacgtagcttttttagttatgtttatttgatgatttatgcataaaaaagctaatatgaagttgtgtactgtactttaaaactacaattttgctaatgctacacttttgtacggtgtgctcaaattagaaaagtaaatacacacgactaagttctctgtagttgccatttagttattgctgtattatctacaaaaccctagtttatattgttatttatttcactaattatctttgaaatatcagctccaataacttgtgataactttttcccatttttaaacattagaatagttggtattgcactgactccatattgagtagctacgtcttggttatcttcgatgtttattttgtatatctttacattttcagtgtattgttgtgctagtttctcaagttggggttctaaactcctgcaaggtccacaccatggagcccaaaaatctactaaaattaaaatattgtcattacaagatgtaaccttgttatcaaattcactgtctccaatttgctcaatcattacttgtcccatttttataaagctatctaatgtattgtaaaacagttataaattatcgcaagaataatgataaaaatataatttgttcaatgaaatgttaatttgctaaatatattttaaactataattgacttatcagctttttgtgaacagcatgtatgatgaaatataagtccatactgtcttttaataggtcaatagtgaacatatgtatacaaagttaatatagcactaaatatgcaaatttttaaatagaaaatgataaaccctacctttttgttttcttgtatttgttattaaatacgcatactgtgtctgaaccatagcgtaaagtgaatgcgctactaactcgttcaataataacataatcacctgatactctaaaattaatcaatgattcatatccttcagaatctacagtaaatattgatggtaaatctgcattaatttgagcaaattgcatataagtgaattggttatcgtcaaaaattttgagtggaacaattcgttgacttcctctattgtgtgatactaaataatcaaaatttagtcctttttttgcaacatcactgtcagttaagtctggtatagcaggttggttaactggaaacaccataccaggactatcttctgaaataaagtcttcagtagaagaatatacaaaccttacttcataggctaatcttggatcatcgagtccttgtgcttcttctgcaaaaaattcaaagtagtatacacgcttgtttgtaattattgttgcatttgtatctgctttgtcggctacaggtttaataaataatctattaccttttggcattagttgccatcctgttgaatcacccatagatatggtgtcgatatcttctccatcgtcaaacactatactagattggtagccgtaaaaccctgtgtacttatgtacagcatggggattgtaagtaataactttgatatgattatcttgtgctatagaacgtacttcttgcttagcaaaacagactgtactgctgaataaaatcaacacaaaaattattgctacgtttttcatctgtagtttgtagtaaaatgtacaacgtttcattctaacatcaatattggaacttgcaacaaatctatgcgaatttagtatgtaagattagtaatactgctgttaaaaatttgttaagcttttgagaaaaggtcttttagacattttattggtagtttcattgatgtttgtactgtagcttaacaaatggcacttttctattttgcaaattagtgtatagaatttcgatatttacagacttgaaatagtagatgagtttaccctgattttagtacttcagtatgtaaaatttacctagagaagttgttactatacttaaatatatcaatctttataaatgtcagtatacagcattttagcatcaggttcactactgttttgtgaaaaatctacggattcttttactatgttacgtatttctttgtcatatttattgcattcatcatcagatataatgttgttagatattagatagttttttaaattggtaataggatctttatgttcttttatttcttctacttcctgttttgaccgatacttagctggatctgacatagaatgtcccctgtagcggtaggttttcatttctaataatattggaccattgtttgctctgcagtaatttactgcatctgttgcagcttgtgttacagaaaataagtccataccatctacttgatgtcctggtacaccaaaactttctcctttcttatataagtctgttatataagatgatctggatacagatgtacccattgcatattcattattttcaattacatatattactggtaatttccacagtgcagccatattgaaagattcatatacttgaccttggttcactgctccatctccaaggcatacaaatacgacattgttattttttttgtatttgttggcgagagcaatccctgtccctataggtacttgtgctccaacaataccgtgacctccaaaaaaatgcttttctatgttaaacatgtgcattgatccacctttacctttggaacaacctgtgcttttacccattaattctgccattacatattttggatctgttcctacagaaagcatgaacccgtgatctcgatagctagtaataatagaatctccatcaataatagcattttgtattcctgttgctatggcttcttgtcctatatataaatgacaaaaacctcctattaaacccattccataaagttgaccggacttctcttcaaacctgcgcattaatagcatgctgtagtaacaatttactagctgttcatttgttagattatgtgaatatttttttgtcatgtattacctaaaatattaatgagcttaatacctgatatatttaatcagtgacattagttgttttatatcaaaatattgctaacttatttattagtatatcgcaacaactaattatgtattaaatattcatacgcattagtataataaaaatagatactgatattagtggtacgtattagtttatttatgtagctagtttttgttgtaaactagcttaacaaccaatttcttatatcctggatttggttattactcataagtgctggagcatgacctatattaggatattctataaaatcaatgtattgctttgaaagaagcattttgtttaatgtagtttttgttaaaatgtttgataagcttccacgtattactaatatcctgctctgtattttttcccatatatcccatatagtccatgcatcagtatcttttatgcaattaatttctttattaaaagctatacctattttaggatctactgctaatgagtaagtcttattggggttttgtataatgctatgcttaataatgtgttgccagtgatcttcttgatctatactgaaattacataatagcttttttatatatatttctgcttcagtaattgtgttaaatattggattaatgtttatgtgtttagaaattttttctaaagctgatactttaatagctggtccaatatcgttaataatgagtttattgattaagttagggaaatatgcagctaaatacatgccaattattccacccattgaggtgcctaaaaaatctactttatcaatttttaaatgtttaagtaggtatattatactcttgcagtaggttaagtaattgtacaggctatagtcctctagccatgagctttttcctcttcctacaatgtctggacatattattttatagtcagatgataagatatttgctaaatagtcaaaatctcgagaatttcttgttataccatgaacacatattaaataattactgctgggactgttagtataattatagtgcattataaatttttcttggagatgacttatatttaatgtatagggtagcataaattaattattataagttgatttaaaatgatattttatgcatttttaaaataagattcaaaataataaaaaataagtattgacatagaatgcatatgccgttaaaaattatatctcacgggatgcataatgtatttatgtatctttgttgtttgacaagtaagcaaaaagaattaattaaatggtaagattgatggtattaatcatcaatcaattcaattagctaagagtataataaataaatgcagttttaatactgcatatatagcaaatgagtaaataataaagagcatttgatggatgccttggcgttaagaggcgatgaaagacgtggtaggctgcgataagctgcggggaattgtcagacgaattttgatccgcagatttctgaatggggaaacccaatcaatttattgattattgcatactgaatacataggtatgcaaggcaaacctggtgaactgaaatatctcagtagctagaggaaaggaaatcaaaagagactccgttagtagtgacgagcgaacgcggaccaggccagtggtctgtagttaaaaattagaatactttggaaagagtagccatagatggtgatagcccagtataagtaaaaagattatagatccttgagtagggcgggacacgtgaaatcctgtttgaagatggggggaccatcctccaagcctaagtactccttaacgaccgatagtggacaagtaccgtgagggaaaggtgaaaagaaccccaggaggggagtgaaatagaccctgaaatcgaatgcttacaaccagttggagccttatatttacatcttgggagcaatcttaatatgtatttattgaggtgacagcgtaccttttgcataatgggtcagcgagttaatctattgagcaagcttaagccgttaggtgtaggcatagcgaaagcgagtctgaatagggcgtttagtttaatggattagacccgaaaccaagtgatctaaccatggccaggttgaaggtgtagtaaaatacattggaggaccgaacctgttactgttgcaatagtattggatgagttgtggttaggggtgaaaggccaatcaaacttggaaatagctggttctccgcgaaatctattgaggtagagcgttgtactatatacttttgggggtagagcactgaatggactagggagactcatcctcttaccaaatccaatcaaactccgaataccaataagtagttatacagcagacacactatgggtgctaagtccgtggtggaaagggaaacagcccagatcgccgtctaaggtcccgaaattgtggctaagtgtggaaggaagtgagaaaaccaatacagctagtaggttggcttagaagcagccatcctttaaagaaagcgtaacagctcacttgtctaaataagttttcttgcgccgaagatgtaacggggctcaagccatgtaccgaagacgcgaattcctaattatattaggtctggtagcggagcgttttgtaagcctgtgaaggtgattcgtgaggattgctggaggtatcaaaagtgagaatgctgacatgagtagcgtaaaagagtgtgaaagccactctcgccgaaaacctaaggtttcctgtgttaagtcaatctgcgcagggttagtcggatcctaaggcgaggccgtaaaggagtagtcgatggaaatcaggttaatattcctgaaccttttaagcgtgacggattttgtgttagtgtgagccttattggattggctcatgctttgaaaagatcccaggaaatagcgcttaagtttataagtccgtaccgtaaaccgacactggtaggtaggtagagtatactaaggcgattgagagaacgatgttgaaggaactcggcaaattacacctgtaacttagggagaagggtggcctatgtgtgggcaaccatatgtaggtggcacagaatagggggtagcgactgtttactaaaaacacaggactctgcaaacacgtaagtggaagtatagggtctgacgcctgcccggtgctggaaggttaacatgaggggtgcaagctccaattcgaagccccagtaaacggcggccgtaaaactgacggtcctaaggtagcgaaattccttgtcgggtaagttccgacccgcacgaatggcgtaacgatttccccactgtctccaacatcgactcagcgaaattgaattccccgtgctgatgcggggtacccgcgggtagacgaagagaccccgtgcacctttactatagctttacattgatgttaggaatgcaatgtgcaggataagtgggaaactttgaagctggggcgctagccttagtggagttgaccttgagataccactctttacatttttgatatctaactatgccccatagaatctggggttaggacattgtatggtgggtagtttgactggggcggtcgcctcctaaagagtaacggaggcgtgcgatggtaagctagagctggtcagaaatcagcttttatagtacaatggcataagcttgcctgactgtgaggtcgacagaccgagcagagacgaaagtcggtcatagtgatccggtgattccgcatggaagggtcatcgctcaacggataaaaggtacgccggggataacaggcttatggtgtctaagagttcatatcgacgacaccgtttggcacctcgatgtcgactcatcacatcctggggctgaagtaggtcccaagggttcggctgttcgccgattaaagtgatacgtgagttgggtttagaacgtcgtgagacagttcggtttctatcttccgtgggcgtttggaaatttgagaggatctgactctagtacgagaggaccgagttggacatacctctggtgtaccagttgttgtgccaacagcatcgctgggtagctaagtatggataggataattactgaaagcatctaagtaagaaaccttccttaagattagatttccccattagggccgtgagagactatcacgttgataggctgggtgtgtaagtatggtaacatatgtagctaaccagtactaatagcccgattgatttacttattttgtaaatatatgtagtgttaaaactgcaaactcatctttttgcttacttgggatttatagtttaattgggttggtggtaatagcggaagtggtacacccagcttacatttcgaacctggaagttaagccttctagcgctgatggtactttgtcttaagacatgggagagtaagtcactgccacccttattaagctataaatcttgatattatttgattaaaaaagtcttttgtaagatggactctttattagttaagctcccttatttacttttcctgttgtaagtatatctttttataattgatgatgttttgtgttgatatatgactgtttaggtcagtgctataaactataagctttattaatttaactttaaaatttgtgtataatgttattgtcaaaattatatttttaagaaagttttagtaaacggtaaaaaacagttcgtatctgattattgcgttttttgttgattttattagcatttttatagattttctttcttataaggtatatgtacactatttttcaggtgaatatgtaaggttttgcttttttaataaaagtattattctgttaaagcatatgattatggggtaaaaaatccttttaatgaaaataagagaaagatgtaataggctttaggtttcttattgttagatttttattaagtaaatgttttgtgattttttattaagagatagggtcgtaatttgatgcttctctggtgattattacgtcatgaacgtgactttcgcgtagccctgctgatgtaatacttgtgaatttacaatttgttttcatttcgcttatatttctgtttcctgtatatcccattgcagatcttaatccacctactaattgatgtattactcctgcaactggccctttaagaggaactcttccttctattccttctggaatgaatttgtgattattttcttggaaatagcgactagcggatccacgtttcattgctccaactgatcccatacctctgtatgatttatatgcccgtccgttgcatattatgatttcccctggactttcatctgtaccagcaaaaatagaacctatcatcacaacatctgctcctgctgctatagattttgctatatctccagaatatttaatacctccatctgcaatgactttaatttttttatttttacatgcatttgcaacattgagaatagctgaaaattgtggtacacctactccagttacaattcttgttgtacatattgagcctggtcctattcctactttaacagcatcaactcctgcttcaattaatgcatgagctccttctgctgttgcaatgtttcctccaattatttgagaataagggaatagggttttaatttctttaattgttgttaaaactttttgggaatgtccatgagctgtatctacaactattatatcaacatcttctgcaattaatgcttcagctctttctatcccatcttttggacctgtacctactgcagctgctactcttaatcttgcaccactatccttgcaggaatttggaaattgattaaatttttctatatctttaactgtaataagaccgacacaacaatagttgttatctactactatgagtctttcttttctgtattgatgtagtaattttattgcgtctgaccgttctataccttctgggactgtaataaggtgatccttagtcatgatatcagatactttacaatttttattttcaacgaaccttacatcacggtttgttaatatccctactaaaagcttgccattttctgtatctgttactacaggtattcctgaatagctatattcctgcattattgaaagtgctactgctagactgtcatcaggagatactgcaataggattatatactatccaactctcgtatttttttacttttctgacttcaagtaattgtgtatctataggtaaatttttatgtatgcaaccaatgccaccatgttgtgctaatgctattgctagttttgcttctgttactgtatccattgctgcagaaatgatagggattcgtagttctatctcatttgtaatgtaagttttaacatttgtttctgaaggcaatacatcggactctgatggaatgatcaatatatcgtcgaaagcataagaaagttccactttttttccataaaagattacttatagagtatatgaacttttagttattcatgcaatagtattactaaatataatctttttaagcagagaattgttcattagttattcgttcttccaaattgcgttctttatcgaatagtaatgtaatagtagtatcagtgtctttcttgatttttatatttgtaatatttcggaattctgtatagtcagcaactgctgctacagaacgtacttttggattaattacatctatttctattatagtagaatttgttaatatagctcctctccatcgtctaggtctaaatgagttaattgcagttaatgagaagacgttagaatttaagggtaatattgatccgcctgcagaaaaattataagctgtgctaccagctggtgttgcaactaaaacaccgtcagatactagcttttccattactagtttgctattgatttttatctgtaaatttgtagcttgatgagtgctacgaaatagagatacttcatttatagcaattgcattgtactgttttttgtcagtatcggtagcaaccatatttaatatggttaattgggttggaattgcttcgttgatacgatctataagattatattctgaatattgatttaataaaaatccgatggtgccatagtttatcccataaacgggtacattgttacatttattcacaacgtaattgtgtaaactgtgaagcatgaacccatctccacctattactattaatagatcaatagctatatcctcattttttttgatgtctataagaccatattgcttttccaatgcaatggctgcagttttatcaaaagcatcagtaaaaacatacccaatgtttttatatttactcatgtgcaactacaagaatgaatatacatacatatgttatatagtatataaaataagatttataaatctaaatcaccaaatttactcataaattttgcagctttactatttttcttgctaacagttcttaagtttggattccatgctggatggttaaagcagtcactttctaggtgaatttttattagttcattcttttttcccaaagtagacttcatttttctttcttccccattagtaaatatggttaatatgtcattggtttctggatgtatcccttttttcatttttgaacctttttgaattttgtaattatgtcgtttagcaaacctattgttgtaacatttatgtatgctatttgtcaattatatatagggcttttaatggttatgtaaattcttttgactaatttaccataacagtatatcataaaaataggtagacagtcgaggatatatacagatgatttttatgtttcctggtcaggggtctcaatttgtgtctatggggaagaatatatatgacaactttgctgttgctcggtatgtttttcatgaagtagatgacatattgaataaaaagttatctaaaataatgtttgaaggttctatcgaaaatttaacttcaacagataatgcacagttggcattgatggttacttctattgcaacattacgtgctatagagtatgttttaggtaagccagtacatttatttaataatataaagtatatggcagggcattcggtaggtgaatgtgtagcattgtgtgcatctggagcattaactttgtatgaagttacacaacttttgcttgtaagaagccaagctatgtatgatgcagtgcctctaggatatggagggatgtgtgctttaataggtggcagcttaagtgatgtagaaaatgttgtgaaaatggctcaagagtatggaatatgtgaaattgctaatgataattgtgatggtcaggttgttgttagtggtgttaaagccgctcttgaaaaattgccagatttaattaaagatactggtataaaaaaagttataaagttacaagttagtggaccattccattcatcattgatgagttctgcgtgtgagaaactacaggaatttattgagagtgttagaaatatgaaaatgccgtcagttaaggttgtatctaatgtatctgcaagagaatatactgattgtttcatgattaagaatttaatagcgaaacaactagtaagtagagttcggtggcgtgaaagtattttgtacatgataagtcaaggttgtactcactttattgaagttggtgctggtactacgttgtcaggtttggtgaagaggattagttcggatgtttctgcagttagcattaacacggcagattgtatagattctataacgcgacatttcacggtaagtacggatcttgttgatgcatagatatagtatatacttgtaactatctttgttattttctcctacagtttttaattatatttttgtgcagtagttttagctagaaatttttaggttactaaagtttttaagctatttgaggtaatgatctgcataagttttgtaaaaagtgagtttattattgcttactttataaggtataagtgacttaggtatttttacttgcatgtacttgagtaattagtaataaagttgtttgtatctaatgtaaggtaatttatgttcattacttttgaaggaatagatggttctggtaaaactacacagtcacatttgttggcggaatatttatctgaaatatatggtgtgaataatgttgtgttaactagagaacctggaggtactttattaaatgaatcagtgcgcaacttattatttaaagctcaaggtttagatagtttatcagaattattattttttattgctatgcgtagggagcattttgttaaaattataaaaccttctttaatgcaaaaaaaaatagtgatttgtgatagatttatcgattcgacaattgcatatcaaggttatggacaaggtattgattgtagtttgatagatcagttaaatgatcttgttattgatgtttaccctgatattacatttattattgatgttgatattaatgaatcattgtctagatcttgtaaaaatggatatgaatttgctgatatggaattttattatagagtcagagatggcttctatgacattgcaaaaaaaaatccgcatcgttgtcatgtaattactgataagagtgaaacttatgatattgatgacattaactttgtacatttggaagtaataaaggtattgcaaatggtatgaatttgtgtgtaggatctacaccttgtttttttttataattttaatggttttaaattaatcatgggggatgttttgaatagaaaatttttagcatggtttttagtctcaatgttttatgcgtatcagtatatattgagagtaattcctaatgttattgtctctgtgtctatggagaagttcaaaattagtgctatggcatttggtcaattttctggtttatattatattggatatacgttagcacatataccgctaggtattcttttagataaatatgggcctaagatagtattaccaatttgtgcagctctaacgtttattggattagtgccattgctaatatcagatgtgtggttatttgctcaaattgggagaataattacaggtgtaggttcagctggttctgctcttggcctttttaaagttgctagtatgtactatggcaacagatttgctagaatgtctggtatttctgttataataggactgctaggtgcaatgtatggaggactgccaattttatctttgttaaataaatttggttgggaaagtttattcttagtatttattattataggagctgttatagcgctgttgctatatttgtttatgttgccttatgataaagactccaatgttgaagataataaaggtctctgtgataaaattaagttgattgtatttaataagtacattgttatgatcagcttacttgcaggctttatgattggacctttggaaggttttgctgatggatgggttacttcatttttaaaggcagttagtaatatggataaagaagtagctgctttattgccttctacaatatttattggtatgtgctttggattgtttgtcttaccatatatgttggagaagaaatcatttaatagttggaatatacttatcacatctgctttggggatgttgtttcctttcctgatgttatatatcagtagttcggttatattggtcacaatatcattttttatgatagggtttttttcatcatatcagattatagcaacttgtaaggtactaagttatgttagtaataatgtagttgcattagctactgctgtaaataacatgatagctatggcttttggttatttctttcatactgctatatcttgtgtaatagatttgttatgggatggaaaaattgtagattcagagccagtatatactaaggcattaatgctaaaatctatgttatttattcctggtggattgcttataggagcaatagggtttatttacctgaaatatttggataagaaagagggtaagtaacacatggtactacagttatatataatcatgtatcgattatatataactgtgtgctttgataaaacgatattagtttgtatagttttttgtgatttaaaacgtcactctaagtttaagtatagagtttgttcttacttatgtgttctaagtagaaaagctaatatctacaacaaatagtttttttcttcttatttttagtaatcaataatttaatataagctatgcgactttttatatactttgattttaaagtattagaacatagattgtaactttaaagttaagataataaagctctgttccagtttttgctattgttaataatctgatgatttcaattaaagttgtattagtttttgactgtttgagatgtgaatttagtaggataatttaaatttacagcagtaaagttatatattttgtttctagtgtttatcagataatttcataatggtgtatcatgagttctatgtatattttaatataatatactttacaacaaaactttttgtaaattctaagataggtatgtcagattatacagattgaatagtactgagataccattttttatttgaaagtgttgtatctttcctaaaggtccatgtgtcttcaatcttgttaatttttgaagtactaccctgtaggatattatcgtccttgtcttttacaaagtttatttgttcgctaatgaattttactgttatgtatgctatattaccagaaagacttaactttgttattttgtgggatgttattgatacaataatatcttcatatagttgaccaagtgctttacgattttctatttcttctacgaatgaattatataaattagtatctaatagcatagataatatgtgtatatttccttcattgaaagcttttattataatttcaaatgcctttattgacccatccatgaaatgtcttagagaaaattctttgtctttctttttaatatggttgatgattgatttatcattttcgttgcaaatttccattacggaatctatgtcaatatcggcagtgtcatgttcttgtgtgtcttccataatgatacttatggtttgtgaatgactgtttgattgtaaccctgaagtttttccaagagagtgatataaacggaaaaagatgaatgctgctaaaaatgcatatattgctaattcaaccatataatcctaatttttattgacaaaaacatatactgtgtatactcaatatattatagcttagtgtacgttaatcaataattaattacattattttacttgggggcttgttagtatgtcatgtaaattgaaagttaagggtcaatatattaaggatctttcatttgaaaatccgaattctccacaaatttttttgatgattagtaaaaccccacctgagattaatatttctattaatgttagttctgtaagtcttccagtaaaagcacaagatcagagtagtgaacagccttcagataataaagtagagccgttatatgaagttactctacaggttaatgcagaagctcgagttggtactacagtagcatttatttgcgaaattaaatattgtggtgtattctctattgaaagtgatgatgtaagtatagaggaattaagtcagcaagatataagagatgtattgttgatttctgctccaactatcctattcccatttgttagagagttgatttctagagttacttctacagggggattccctccgttaatgcttgatattgttgattttagagctatgtatgaatctcagatgaagcagggtgttggacagaatgataatagtcaggatccagaaaaatagggttttgttaaggataatttagtttgttagttaggacagcttatagtttgattagttaagttaatacaggtttttgtattatgaaatgtttagtgataagtaagctattctttttgtttgtagtagttttcttctttaattttgcattttgttctgataataacaaacaagagcctgaacaaaagttttattctgatactcttgtaaaattagatgatgatatcactgctcaagagttattgagcttgttgcctaatgaccgttttataggtaatacaaaagctccggttatcataatagaatatgcttctttttcatgtatgcattgtgcacattttacactaaatgtttttccagagttggagcgtaagtatattaaaacaggtaaagtgttgtatatttttaggaactttcctttagattatatatcattaaaagctgcaatgttaggaatttgttacaatactgctagtagcttttttacttatactaaggcagtatttagctctatagaagcgttagtaactaattataaggatttgggtgtattgtctaatattgcaaaaattagtaatgttactgatgaaagatttgagaagtgtattaatgatgaagatataatgaattatattgtgcaggagaagtttgttgcaaatagaaaattacaggtaaatgctacacctgtgttttttattaatggtagaaaatatgataagccccatgatattgaaagcttttctgaaacaattgatgaattaattatgttgcatccaaattattcgttagtaggtagtaaaccttaaatctgtagaatttatcgattctatgttcaagtattgtctgtctatttaaggtataagaattgcaactaagaacttttttgtagtattttttacttctaaatgtaagtctgttatatgtaaaacatttgggctatatcatcataagaaggtaggttttcaatttgacctatagctgctaaggttattttgttgttgctacctagtagattattaatacagttctgaatgtctgtgactgtaattgtagatattttctttattaattcttcttttgaaatgtaccgattgtaatgggaataatagtaccctaaggattcagcgcgtgcagtagtgctttctcttgacattaatatttcagatgttaatttaccttttgctcttgttatctcgttttcttgtaagtttgttatgatattttttacttcagaagctatagtggaaagtaattgacttaaattacttttatctgttgctgcatatatagagaaaatgccgttatcactgtaacttgagttgaaagatgaaatagtatagactaatcctaattgttcacggattttttggaaaagacgtgatgacatgccatttcctaagattgaatctaaaatttgtatagtataaaacaagtcatctttatatgaaacactagggaatcctatgacaagatgtacttgttctaagtttcttatttctctatattctccgctgcgataaattgatggatctgctattttacgttgtgattttttcatatgagaaaaatactgagatactaaatcaatgacttcttcatgtgatatgtttccagctactgatagtaacatgttgccagcgtgataatattcactcatgtagatgtgtaaatctgctttagataggctatttactgattctggggtacctaaaatggatttaccaaatatttgattaggatacgcagcttctatatacttatcaaaaattatactagtaggagaatcatttgtttgatatatctcttgtaacactactcctttttctttgtatatttcttcttccggaaattgtgaatttagtattatgtctgcaagtacttctatagctattttaatgtctctttttagtgtttttacatggtaaacagtatgttctctgtctgtgtgagcgttaaaatttccacctatatcatcaaaaatttgtgctatatcaagtgcagtgcgagttttagtgcctttaaaagccatgtgttctaaaaaatgagagatacctgttatgtttatattctcatacctacttccgacgtttacccaaatgttgatagatacggattctacatatggcattgtgtcagttattatagtgaaattgttgctaagttgtgtaatttttggtgacatgactttaaataaggaattaatgtcttaagtttatacggttaatgatatgacagcaacaaatataataaaatatcagtgtatgaaaatcatgatttaacctaattttgaagatttttcataactacattttgttaattaattatgatcttgatacattagtacatacaatactatctaaatacttgttttatatatacttttaatggtacattgtggtatgtaaatggtagtgttggttgtacggcttgtttaataaggagcaattattatattcgtaattttcatataaatgctacttattttacaatattatttgtgtaatgttagctaaggtgttaacatggcaaggatttgtggtggattgacggagtagtaagtttagctggtattatcctatatagtgtatattgggttaattttattacttgagtaaaatttaatatttagtggtcatgtattgatttgcattagtaaattataggtatttgtggtttttaccataaaaagtgggaagttatatagcgtattgtgatattgatattgcttgttaaattgcaaaaaaaatgataaaagtgacaggttaggtttctcagctatagtagaaaatgtatagtattgtcaatagattaaggttttaatttgcgtaaaaaaattaagaaggtattgatttccggtaaaagtgtttggccaattatagaaggtggtaaaggtataggtgcgagtgatggtagaactgctggtgcttttgctgctgcttctgctgtaggtactttttctggagcatgtgctagattagttgatgataatggggagcatgttcctttaatatatcgtggaaagactaggttagaacgccataatgagctcataaactatagtattgatgcagcagtgagtcaggctagaatggctcatgagatatcaaagggattgggaagaatacatatgaatgtactgtgggaaatgggaggtgttcagcgggtacttcatggtgtgcttgataaggcaaaaggattaatccatggtattacttgtggtgctggtatgccatataagttagttgaaatagctgctcaatatcaagtttattactatcctattgtttcttcaatgagagcatttaaaattttgtggcaacgttcttatcagaaattttcaaaaacacttcttggtggagttgtatatgaagatccttggttagctggtggacataatggacttagtaatagtgaatctcctggtcatccacaagatccttttgaaagagttgcagcaattcgcgcatacatgaatgaagttggattatctgatgttgtattaattatggcaggtggcgtttggcatttgaaggactgggaatcatggttagataatgatttaattggtccaatagcatttcagttcgggaccagacctttattaactcaggaaagtccaatttctcctgggtggaaaaagaagttgatgtctttgaaacctggtgatgtgtttttaaatagatttagtcctacagggttttattcttctgcgattgaaaatgagtttataaaagagttacaagcacgtaatacacgtcagattgcatttgaaaatgagatgactgaaaaatgcagtgcagagctttctattggtagtagaggtagaaaagtatatgtagatcctaaggataaaaaattgtccgagtcttgggtagcaatgggttatacagatgctttaaaaactcccgataatactttaatatttgttagtcagagtcagtcaagaagtattagggaagatcaaataaattgtatgggatgtctaagtcattgcaaatttagtaattggaaagatcacggggattatactacaggtattaaaccagatgttcgtagtttttgtattcagaaaacgttacaaaatattattgctggggtagaccatgaacatgagcttatgttttctggccataatgcatataagtttgtacaagatgagttttatagagatggttatattcctacaatcaaggagcttgttgatagaattttgactggatattgatattgttttatttgtaaataaaaacaatagttaggtgtctgaagtaaaaagtattttttattattaatcacatagaaattcttcctgtactttataggttttgtggtatttgctgctgctagtttttagtaaatataatatgtgtttatgaaatttttgtttggctgaaagtgtagtagcttttctattagtaaaattaatttgaagtttagcatgtataagcatctatgtgaaatttattgtaatatgtaactatactttaatattatgctcgtatagacgttctaagtgttttgcaagcatgtctacttctatattgatattgtcatttactttgttgtattgaaaagttgtctttttccaggtatgaggaataatgtttacggataatatattattagatatggaattaatggttaatgatactccatctatagctattgatcctttccttatcatgtattttaatagcgcatctggtatgtgaaattctatgttgtgagaactgtttacgttagtaattgagataatatttcctactccatcaacatgtccttgtacaaaatgtccatctaagcggtcagtcatttttaagggtaattctagattaatctttgttccttctttccaatgtgcagcactagtaacagatagagttgcatcggaaacatcagcagaaaaacactcattgtctaattctactgcacttaagcaaatgccagaacatcctatggaatcacctattttcgtctcacttaaaaaattagcattggtgggttttattacaagtcttctatcctggccttttgtgtaatctacttggataatagtaccgatatcttctattatgcctttaaacatccaatattgtatcatgaattgtggattcggaattctagtatgatgaatgaagaaatgtcaataggaaaaaaatgtgtaaggtaagtctgctagcaaatatctaaaaaattaatttattgcataataattataatttttattaaaaagtatatttttattattaatatatgttaaattttgtaatactttatatgaaagaaaggacttatttgtatgttaaataattttaatgcttcaatattacacgttggacgtaatgtgagtaatcatagtgtattcgatggaatttttgaccattctgatgattttactggtaatgatacactgattcctaaaggttttaacaacatagggacaggtagggatgatttgctagctgctggtgtcattgcgttttatgtattggttgtagttgtagtgggaggacttatttattggattggaaatcgtgatcttatgcgtcaaaatggttatacaaaatgtacttctaaggcttctattatgttagaaaacacagactcttctgatagtcatgtggaagaaaaaatttctttgctaattgtttcagacgatattaatccgcaagaatcaaaggaagaaagtgaatgtattccaaaagtattggatcaacagcatgttgcttcaattcaatcaaaagaatgttcattacattattctcatgttgtgtaagtgcaatagttgatatgtataattatgtatttttgtttgtattaagaattttgttgcctaaatgaatctgacagatgtgcaaacatatatgtatagcagaaagtgggatagggagtagtagctttttttgctaaagctttgcaaacatgtaaagttagtatatgctttaatccctttcccggaatataatgtatataccccataataactgtaaaactgatgattcttaggtaaagaggtttgcttatgtaaaaatgttattttttgttattgtgtttgtatatgtaggatagcaattttctaaaatacaataaattgaaatatgattcatttttgctgtttggtaggttaccttgttatgaatattgatttagacgagaattattatataattgataacatatcttgatttttttctactcatgtcatggcttgatttgttaaagtctgtacttacttctattgttgctggggtgagtgattatacatcttttatattgaacaatactgtaaatggtacactagatgttacacgtcgtaatgttacagcactgcatgatatacttaacaacacactgactactatttctaataatgtggtttctaatattagtagtactactgatagtataggaatagttactagtaggattggtaattatacatcgtttatattaaacagtactgtagatagtatactagatgttacacgtcgtaatgttacaatgctatatgatatctttaacggcacttttactactagtaatacagtttctaacattagtagcactactgatagtgtgggaatggctaccaataacagcatagttagtcaggataatgcagcttctaattatcatataaatactattatgtatgttgttatggcttgtgctattttatgtatgatgcgtcatatttgtcaccattttatgcaaggagtgcaaggggaaagacgtgttaggcgtattgcacgtgagtttagtgagataagagaacctcggatgtcttctgatgttaatattacaggtatgtcaagagcatctatttgttgtgattctagggaagatgttgaagtacaacagagtagagttaatatagaaggggaggggggtgttgctactcagcttgatcttgagtacgtaccacagaatgtatgccataggttgagacattggatggctcgattgtgtcatagaagaagtactgtatatagtgttggtagtgatttagggatggaattagatgttatgtctagagttgaagaagaaacagaatgtgttgaagaaagtatgtctttttagatattttgtgatttgctattatatttagcagttattctcaagagatagggaagttacatttcatccgattactaaattcacatgcaatacgtctttcctcttacactccttgtataaaatggtaacaaatatgacatatcatacataagataacacaagccacaacaacatacatatatttgtagtttatataaagtggagtttaaattttcataaagattgtgatatcaacttagtatgttatctattttttatttatgttgcttttcaatagattaggatgtgctttgactgctattgtggttagtgttagtcatggtgtatcgcgtatcatagatactactttcataaagattgtgatatcaacttagtatgttatccatttttttatttatgttacttttcaatagattaggatatgctttgactgctattgttgttagtgttagctatggtatatcgcgtaccgtaaatactactttcataaagattgtgatatcaacttagtatgttatccattttttatttatgttacttttcaataggttaggatgtgctttggctgctattgttgttagtgttagctatggtatatcgcgtaccgtaaatactactttcataaagattgtgatataattaacttagtgtgttatccatttttatttatgttacttttcaatagggtaagatgtgctttggctgctattattgttagtgttagccatggtatgttgcatgtcataaatactactgcaagtatgggaggtgaaaatgttacgacaactatgcgtaatatatttactcgtgtttttaacaatactgttgatagtacagtagaaaatgagagtacaacaattccttctgcattaaatgatacagttactgatattgtgaatagtgctgttaacagtacaatggaaaatgggagtggttctgcaacaatttcttctatcttaaataatacggttgctgatgttgtgaatagtactgttagcagtacaatggaaagtgggagtagttctgcaacaatttcttctatcttaaataatacggttactgatattgtgaatagtactgttagcagtgcaatggagagtggtaatggttctacaacaatttcttctacattcaatcgtacgattactgttatctctagtagtactacaggtcagtctagtggaggagagtatgcacttttacaagcatttataatggtgatgggtgtatttctgttaatgttgtcgttgttgatgtgtgtacgtagtgttcaaagatgtagaactgatattctaagagctagagcgcgactcaactatttacgagaacatggaggcgaccctcctgatactgtaaataatgctgcaatggaattagatatagtacgagacgttgaagtggtaactgacgagttaaaccttgaaaatagaccttgtctgtgtcagcatgatcatcaagaagctcctgatgatcctgttgagcaagttagacctgtgtttaggttacagggaatattccctagatgatttgactaggaagatgcaatacgtgatactcaacttatgaatgagaaagtatcaaataagttttttgtttattgacgtaatgatcaagggggggggggggataatatttactggttaaattaaattgattttgagattgctggatgcttttggaaattatatagacaatacgtaatatccaatagtatgtgtaatttatgtaaagtgtgatctaaattttcataaaaattgtgatataattaacctagtgtgttatccattttttatttatgttgcttttcaattggttaggggatgtgttaatttctcttgtgtctagtgttaatcatggtatatcgtatgtcttaaatagtactacaagtataggaaatggaaatcttacaacaactacattaagcaatctgtttactcgtgttttggacgatactgttagtagtacagtagaaaatgggagtaatactacaacagtttcttctgcattaaatgatacagttagtgatattgtgaatagtgctgttagcagtacaatggaaaatgggagtagttctacaacaatttcttctatcttgaataatacggttagtgatattgtgaatagtactgttagcagtacaatggaaaatgggagtagttctacaacaatttcttctatcttaaataatacggttagtgatattgtgaatagtgctgttagcagtacaatggaaaatgggggtggttctacaacaatttcttctgtattaaatagtacatttactaatattttgaatagtgctgttggtagtacagtagaaggtagtgttggtaatgctacaacaatttttcctgtattaaataatacggttactagtagtactaggaataatagtctccatgatagtacacttattgcagcatttataatgataatgggtacatttctgttaatgttttcagtgatgatatgtgtacgtagtgttcaaacctgtagaagcaatattcgaagacatagagtacagatggcatatttacgagagcatgggggggggggacctcctgataatttgagtgatgctgtgatagcattagatgtgataggagaagttagtgttgtgactgaaagttcaaacgttgaaaatagaccttttctgctgtgtcagcatgatcatcaagaagatcctgctgattctgctgagcaagttagacctgtgtttaggttacagggaatattccctaggtaatttgaatagaatagatgtaatacataatactcaacttatgaatgaaagccagaatattatttggcttggtacttcttatatattgttatgtatataatttatgaagtcttttataagtttatcaagtaattaatatataaatttgttttgtatttaaagggtattaaccctgtatgttgtttatacctatacactatcaaatgtaatacagtgccattataaaaaatagtgctttcattgagcattgttcaataattatgtcaatgatactgctttgtgtcatacttgtatactttaatcatctagtgtaaaatgtatggacatagaggtgtcacaatgtaataataatacaggtgaattgccgcttcttcttggtaacttacatgtcaagcaataggtagacataatagttgggaggtatctcatagatgtggttaatggtatatttattaaaagctactctacataacaaattttaaaaggttattatactttatttgattttagtagtttttgatgataatgatgcaagttatgattgtgtaaataataagaatattaactcctgttagaaaatattggctgtatctcttgatatgactgtaaatataagtgctactcttgattgtatctgctaattagaagttatagtgtaaatatctctctttgaggaggattatttgtagatattatttatgattgttgttttgcattaaaggagcaatgcttagagaaattaaataatattaataatagtgtgtgtttatatgaatgataaagtatttgttgttaccataattagtatgatagtattggtaactttagtattcttttttttcccattattttcaatatgtcatcgtgctgtaaaggataatacgaatcaacaggataataatgtgaattcagaattagatgatctagaaaatgttagtgatgatgttgtattagtagcccagcagcagaagctgaggttttgatgttgtgggtttgctctaatatttttcagcagtatatctaccaaaatatgtgtgttttaacattggtacacttgaaaaagatgatgttattgtgaaattttatctcaaattaaaaatataaaatattttattgattaatgtatgtatgcatttcattacattatgaatattactgtaaaattgtcttttttataagatgaggtaatgagtagatattgtatagtctatctatattttatcgatgtataatagtgattactctcataataatgcaaagtgtgtgttattagcgtttagaattttgatatcaagaaattaatatcagaaataaagattaatactattcatatatagcttctaactaactttcctgatatttttaataataaatttataatattgctttcttgtttaataggtttattttgctaatgtggtgtataataaaacttataatgcaattggaactgttgttaattagcataagtatactattgttttgtatcttaaaagttagagggttattgataaaataattaagaattttttgtttaagagttgtattgctatctatttttaaaaggatgctgttttttatttgttcgacttcataaatgccaatatttgcacacagttgttttatatatatggtgttcaataagttttctacttcgtttggcaatttaccaaacttattggttaactctatatagtaattatctatgtcttcttttgttttaagactgccaatttttttgtatactcgcattcttaatcctatatcttgaatgtaatgctcaggaattcttatattaacattgatattgatatttatatggtcaagatctttaggatattcactataaatgttaagttcttcttctaacatttgttggtatagttcaatgcctatatcttttatgttacctgattgttcttctcccactaaattaccaaatcctctgatatccatgtcatgtaatgataaattaaatcctgaatttatagaatctattgattgtattatctccagttttatagcagatttattggttgctttttcagataatataaaatatgcaaaacccttggtactgctacgtcctactcttccttttaattggtagagttgagctaatccaaacatatcggcattgtgtattatgattgtattggcaaaagggatatctaatccacattctataattgatgtagtaagtaatattgtgaatttgccatcaaaaaaatcgttcattattgtgtcaagttgggtaggggaaagttgtccatgggcagtgttcatttttatttctggtactaattttcttatcttgtcgctgatgctttttatattactaatttgtggacaaacataaaatactctaccgcctctattatgctctcgtattatagcatcttttattatagtttcttcataatatgttgtataagttgtaactgctaatctattttttggtggtgtttttattaaactcaaatcttttattccacatagtgacatgtacagtgtccgtggtattggagttgcagatagtgaaattacatgaacgtttgttttgattttttttagtaattctttttgctttactccaaattgttgttcttcatctataattaataggcttaagttagcaaacgtaacgtcctgtgctaatatggcatgtgttcctattattatatgtacttgtccacatgataaactttctttagttttttttatttcggatctcgcaacaattttagataattgtttgatttttatattaggaaattttttgaatctttcagtaaaaacaataaaatgttgcctgcacagtagagttgttggtactataattgctacttggtagttttgacttgctactaagaatgctgctcgtaaagctatttccgtttttccaaagccaacgtctccgcaaattaatctattcattattttaccacttgatagatcatgttccatgtcttttatggcttgtaattgatcttctgtttcagtataagaaaattcattacagaagtgtttataattttcatcagggaaaaatgatttgccagtagagagtcttcttgctgcttctatagttaataattcttttgcaatttttttgatatggttttttattttagttttacgttgttgccatgatgtactgcctagtttatcaagggtaacattgacattttgttgtccatacttggatataagattaatattttctacaggtaagaatagtttgtcgttgttatagtactctattttgatgaaatcatgataactatcaaatactttagtagtttcaagtgctactattttcccaataccatagtctttgtgtattactatatctccaatatctaggttagtatcattgctaataatatttgaaatgttacttttattagttgtttcttgtttatataatagatcgtgttctgctatgacaatagtatattttgagataaagctgtgatatattggtaatatagcaatattatatgaagagcatatttcctgatagttttctattttgcatagtttgatatttaatgttctaagtctattttggatatattctaaagagccagtagagtaacaagctattattaatttttttgtgtgacatgtagttttgatatattgtgtcaatatttcaaatatgtcgatttgtttgttttgtactaatgttttaaaatttgggacgttttgtatcttttctgtaatgttgaaggaagaagtatgtatatttctatcggtataggctgaattattactagtgttgtcagattgtgagaatatagttttatgaaactgtttagttataattttaaattcttcagaatcaacgtaaagttgaggtggaggcacttggtaggatagttgagatctgtaatttaggtatatctgattattatattcttttatttcatttataagcttatcgttaaatattaatgttgtgttttgtgatatgtagttaaaaatattttgtaattcttctttataaaataaaggcaagaaattttcttctcctatgtgtttctttccagagattattgtgtttaataggttttgatcttggtttggttttgttttataggttttagaaaaaatatctatattttttttttgttttattatttcagaagtgggataaataacaacctcatttaaagaagagttattatctattaattgtgtttggcgattgaaatagtgaattgattgtataagattattatttaaatgaatccttatgggatttttataagttgtaggaaaaatgtcaatgatgttgttgtaagtggcaaattcacctatatcttgtactattgagtattgactgtatccgtgattggttaagtaatcttctatatggttttttgtaatattctgtagagatgtaatttttaatactgattgtaatatgatattttggtgtaatactttttgagtaattgcattaattgttgaaataataatatagggattatcattatgtctagtgattagggaatatagagttttaattctttctgccataactgaattatgtggagaattttttttatatggtattgaattccatgcaggaaatatgattatttcaagatttggaacataaaacttaaatattgatgctagattatgtagttgtgtttcttgattgactatatatattgcagaatgaattagtttttttatatacatttttattatgacaagtggttctagcgtttgtggaatattgaagattttattaatattattcatatgatagtttaatgattttaatagttgatattgtaagcagaaaatatagtctataaaaatgtattaagaagtctatatttcaaagacatgtatagttgatataataagacttatatttgtgaattgcatttgtagtatacatcaaattttattgtgtggaattgttctttcattgtaatttctaagtttatggttaaataaaagcttgaatgttgattaacattataacagtataacataaaagttttatattgatttaagttataagtaagtatcttttgtttagtaaaaataccttatattgaacatatattcaaaagtaattcacttgtaaatcccagtttacaactttccactaataaagacctatacttttttcattgaattaataaatgtataagtgtttgaactacgtttgaaaatccaataataaggtatttttctaatctttaaggacgatataccatatcctgtgatcctgattgcaagtctatatgtgtaacactactattaggattatcacatatatcaactataaaaaaacctgatgcttctaggacatcttcctctgagatgaattctatgtctgaattagtgtcgttacttaccgtatctgaatcatgttgttcatgactatctattggcatgttttctgtatcactaataccatctgagtcagtactggattcccaaactggaatctcgtcttcattattccgtcttggagtttcttctatatcactgagactgtctaagttagcactagattgcaaaactggaatctcgctttggctggtatgctgctccatgttattatggtctgaactttgtgtgttctcattagaatgcgtcgtagagctgttttcattgtgttgggggttattgttcgttgcattggttggtattattggtggtactattcctgatattagtattctaggtaatacatttgctaacatgtttccccagtttcctagcgtggtaaatattgaacgcaatatgttccatataggattggaattgcgtgagttattattatttgataaatctttcactttatccctcaattttttaactatatatatactgtcaagtataatgtttgtgattatattgtgttaatatattgttgacaagtgtaagatttgtacaagaaattcttatattttaagaatttttgctgttggtaattttcacaaattgtagtcatgagctatataatggatacagaaaaaagtatgtatgttaattgatttgatgttaactgtaataagaagaattttgaattgcttagaatgaactctggatgaagtttagagttttgttattgttctgaaattaatttataaagtatattggctgagttgctaatactagtaatagtttacctattgtaatggtgaagtattcattattttagtgagtgttggttaatttgattttactattgtgcaggaacttgctcgtgtatgttatggtgtataatcgatatctgttgtgctgatattaggtgaagtgataatatattctccatgtgtgcaaatacttgaagttttttccattagtttttattggttagctaactgttctctagttccaagttatttggtggtaataagtaaatgacatgttttaaaaggcaagtgagtattgtagtgtgcaacatggtctgaaagtacgcataagccttattcatctgttacaatgatggatgattaagtattgtgtggttaaagaaataatgatcaagagaaggatatctgctttattatttttagcactgcttttatttagatacgcataagccctgttcagttgctgcagcgaatggcaaatattggctaggtcaagaaaataataatcaagagggaacatcaactttgctgttttttagtactgcttttatttaaatacgcataagacctattcagctgttacagcgagtgatgtaaatattgctaagtcaagaaataatcaagaaaagagcattaactttgttgttttgtaatactgcttttatttatgacattgtgcacacaacctaaaaaacttattaaggttttaagtaatgctacgtcctcttactgttattggaatttgtaaaccttgtactctaaatatattttttattgataatgtataaaatacgtaattttaaaatgacataatgaccgttagtgtaatgcttactgttgtgatgttaatgcattttaagtacatataaaatttgtcttttatgtatttaattgatagtcttatagttatgcatgaggtgtaggtattgatttaaattaaacttgtataaaaatggctttataaaaggagaggttgagtaaaattagctaataataaaacttttttcataatctttcagtttatatgttgaagtttgttattagtaaaaattacgttttgcaaactatgtatcataacacaataaattacaaagttatcaacaaaccttcgcgcagtattatggataaattattctccgactatgtgcgatttcagctgcgttaagtataagtgattctactggtccatgttgtgttattaatgtagatagtggctctggttgttctgtcgggtgtggtgatgttgttgcttcttgtgatcctgaagagtgtccttctgaaggcgtagcatatgtatcgctactgctacattcttctccgtgacttgtagaatcacaagtttcttcttgtggaacaggaatatattgttgttgttgtctgctattatacgcatcagcaatgcaactacaacatttagcaaaaaggaatgccacaatgttaatcaatattgtagcaagacggtataccattgtacatgctaaaattcctatgaatattggtgatagcataattataacaaaacatagagctgcagctgatagctttttgctgacatactgtagatgattcctagcagaatctgaaagtctgcgaaacggatttcttacgctaggtgaagggaagattacatcagagtctccataaacagatatatcatcatattctggctcttctggtaaaggttcctgattagtactgcgtgcataattacaagatagagcccaaggaagaataaatgtctcattgaatatcatcataaactgacgtagcatcattactactataccgacaactatgactggtacaaatagtataagatagagatctgtgactaacatcaagcattggttaagtatagctcttttcaagttttttgcatgtctactaaatactgttgatggtcggcctcccggaaccggactaccgccttgttgttgttctgcttcttgttgttgtagtattacttcttgtcgttctgcttgttgtcgtagcatttcttcttgttgtagtgcttgttgtagtagtgctgcttgttgttgagctgctgcttgttgttgagctgcttcttgttgttgaacttcttgttgttgaacttcttgttgttgaacttcttgttgttggtctgcttgttgttggtctgcttgttgttgaacttcttgttgttgatctgcttcttgttgtacaacaatacgtggatctgttatgcttctcactgttattctccatgaaaaagatagatagaaattatttaattataaaccgtttactgattaaaaaacaagtaaaaattgttagagttgtatttcgtatatattatatggttatgattatctagttgatttgattgagcttatgtttgtgtaataattgtggtgacttgatctgtaattataagcttatgtaaagcttatatcgtaagaaaaagagttggttttgaaaaaaattttttattgtacttcaaattattattaatagataggtgtgttttgtaaatcatatagtgtatttatgtaataaatacattgtaagttgatacctaagtataaatatgctgatgtgaattacatgttgtttgtgagcaaaaaatatcgttattatcatactctaaaagagctttttcatgttattgtaaaacataatagctaccatacttagattgagtactacttgatactgctctttttctaatatagtaagagtttatttcttgctaggtttgaaaaatgtgtaatataagttatattcattttgaataatatgatagctgtacattagtttcgttatttatgtatagagccgctctcttgtgtatttgtagtgcaaacgtctgttaagattacagatgggtttacattattatcctcttcattcatcagtctaagacttccatgcaacaacagtggtatttcatcatcatcatcaaggccattattactttcagtatcattagtatctgtgttgcgtccgtgtgtgtttgtaacgtgaacctctgttaagttgataagtgagattatgttttcttcctcttcgtcatctattagtgtaagatgtgcattctccaacagtggtatgttctcttcactgtcaaggtcggtatcactatcactatatccagtttcagtttcagtttcactatcaagaagtaaattattataaggatcagtgcgcgttggaaaaaacaactttactacagcaatcataaaaacaactataagaataatactatagaatatcgtcgttgccatgtcttcagcagtatcgctggaaggagtggtaatattcgataatgttccctgtgttgttgtcagtgctccagtaggatttgttgttaagtttgtttcatttgtcataatcttttacttaattgaatgaattaagaggtctatttactagaattatttatgctagtgacttatggataacttgattaatacaaatgtattccatttttagataagcacacctgcaaatgataacttaatactgttagttagtcaatttttttatgattttagttcatatgagctgataatataacaagggcaataactttctattgcatttggttgtttatggtagaaaaagatagcgtatatctatattactcaagttttttgcaataaaagctggatcaatgaaggcttaaataaaaaagtgatagttagtagcattatattctaaaaagactacataatcatatgttatagaacattgggttaatttgttttcttcatctggttaaaaactgtgtgatattattaaaaattactaagctggataaaagtaacggatataaaaattttaacctataatacgacgcaattgtatttaattgtttagttattataatttagtgacttgattgtctccatgagattgtactgcattgctagctaataaagatagatttgtgctaacttcttcattttcttcatctgaagtagaatgagcatcattttcgttatgaaattgtactgaattgctggttaataaagatagatttatactagcttcttcattttcttcatctgaagtaggatgagcatcattttcgttatgaaattgtactgaattgctggttaataaagatagatttatactagcttcttcattttcttcatctgaagtagaatgagcatcattttcattatgaaattgtactgaattgttggctaataaagatagatttatactagcttcttcatcatcttcacctgaagtagaatgagcatcattttcattgttttcactatcaaggttagatgaatgtgatgtactattatttgatgctaacgctgaagaattacaagatacatacccttcatcaattgatggattttgccttatttgttgttggttattattaaatagggcactcaataggacatagagtacaaagactattgaaacaaaacataggaatgacattaatccagtcttaaagtagtcagagggttctttgaataggtaggatgtgttgcttgtagtgttaagtgtaagggtactgtttgttgaatttgttgtaggatatgtagtgttagaagtgagtggtgtagtagaatttgttgtggatgctgttgtggtttctatagtagtgttgataatactatttgatattgtatttaatgtgtaattcacaccttctcttatgttgttagtagtattagttattgtagaagttatggtagaagcgatattacttgttgtatctgctatagcttgcgctgtctcactaatagcacttgttgtgttgttcattatagattgagtactacttgatactgcatttattgtagaactaagaagtgtactgtttgtagatgatgtggttactgtagcactacttgttgtactgttcataggatttgtggttattgagggaggggtagtagtattgaccataaaatatatataaataaatctaatgacttaattaataagagtgaaacattgtccagtttaggataaaaacacctattaataaataagttgatattacttaattagtcaattttttattatttcagtgagtatgagttaactatagtaagatttaatggaaaattatttgtcatatatagcttttgataagagaaattaaattggtagaagctgttagttatttacaacattgaagtgttgaaaaaaaaaagataatttattgtgttttagtagataggtttatatgtatctgttgactcaaatttttcgtggtaaacagctaaataataatagggatatattagaactatatatgttctacatcctgagggagcactaggtagtttacttcctcctgaactgttgtagaaatatatgttaattattgggatttacttgccctattatcgtgataccgttgtgtgttgaccgcctgtaatactgtgcttatttcttcgtgctcatcttcgtctgatgaagcgaaaatatcactctcattgttttggtcagttgtgtgagaatgtggtgtacgtaaaattggaccttctggttgtgaagaggggggggggggtgagttcgttgtttgtatcatcatagtcatggagttgcagttcgaactgcgatagtgattcttctaatgtcccatcgctgctgtgccgcagccttctgtgtcgacgatgtgcattaggtaaataacaacagtgatatatcatcactattattgctgctaacaacattattatagaacaagtaataagaaatgtttgatcttgttctggttgatttgttgtcgtattagcagcatttgttgtagtattaaatatagattcagtaatattgcttgatgtagaattatttgtagtgaaagtgcctgctgtagtggaagatgttggactgcttgtagattgtgtgacactactagtaaaattttgaaatgctgtacttgcagcttctgatgtagcattgacaatatcagtaactgtagaagagatagcagagcttaggttttctgctgtggattgaacgctgcttacaattgtgcttaatggggaagtattagtaggagtgccttgtgtagttgtcgtggcatttgttgtattattcaccatagttttcttacctgaataatgattatatactttaattgataaaagagagatgtactttctagatttatgtaagtacacctgttgattgtaggttagtactgtttgttagtcaatttttttatttcagttcatatgagttggtgatataacaagatttgtgttgaatcctgatttgcgtgtgtaattctataattatagaaaagttattaaagtaattcttttaatagaagcttcaaaagatgattttacttaaaagcatgtaatgctttataaaatgtaattcttactttgtattgctgaaactggaatatatgctaactaataggagtaggagaatatttttagaaagaatctgcatttgtagtggtcatatagtacaatggatctctattcttattctatggaaggagtacaagtgaattttttcatgctgtcatactattagttagtgtttttataattatgttatcagatttattattgatatataaaatttttagtactctaaaaaatagaattgatgtgtaatatacacatcaaatcaacaaaaggatctttatagaagataatgagaataagtgtaacattagagataatctgattaaacctatagtatgatagtataaaaaattcgcttatactccttccatagaatagatatttattgtatgaatgtatgtataatgttactgtataaaactataaattgtctttactaccttaactatatagaaactaagtaatatgtatcatacagtatttactatgttgtttatataactagcatttacaatgatctataagcttgtcgttaatcatacttgtgatgtcatttttcatcgaagcattataagaacagaatgaataaaattatctaccttatcttcctgaagcgttagtagaattactattattatgtcttctagtgttattgtgtggtgcatctacatctactaatgccataacttctctgtcagttagctcaggttcataaaatgagtcatatagtacatagttagtaaagttagtatgtcttctaatctcaaaactagtactacgagatggtgcagtagtacttacttgattttctctgttcctgtgcatacggcgacatataataatcatcagtataaataaacacgttattgctataatgggtgcatagattgtaactgagttatcactattagtactattgttactttgtgtagaattagttatgttcgtattattcataattatattaaaaaacttaattttatatttttatttatataggttaataaattaaattcaatatttaaatataaaaaaatccttctgtagtgaactttttttaattatgggtatattttgttttgttggtactttaggaaatgagttaacgactaagtatatgattaatgttgtgatattacaatgcaatagtatgtaatgcacatcacgagtattttgtgtaaatagttaaaaaaggttccttttatctgcaaaaagcctacagcatgcttgacgagcttaactttatgctatgatctacaccgtaaacaaagtcattaataagtctgttaattgagagccaggtgttccgtttgaaagaatacttcttgtaaatagctataaagaaaaaagattctttttatctgtgaaaagcctacaacatgcttgacgagcttaactttatactatgatctacaccgtaaacaaagtcatcaataagtctgttaattgagagctaggtgggtcgtttgaaaagaatatttcgtgtaaatagttatagagaaaaaaaggttctttttatctgcgaaaaaatctaccacatgcttgacgagcgtgagctataccataatctacactctgaacaaagtcatctagtaggtctgttaatcgagagctaggtccgtttgaaaaattgtacacaggtgtaaccgagtcgtttgtttctataacacgtggtgagcgaccgtgcctaacatctgtattctcatcgcatcttacagatactggtagcacactaccatcgtcaaacctaataacatcaccatgttttttgtatcccttttttttgtcggaattttcttctgttaatggtatctcttcgtcttgatgacgttgattggctcttgtatgttttgagtgaatacagataataaatgctaataataataaggaaaaaaagaatatgcctatgagcgctaaggtggtctcctgtttgttatcattggatgttgtattagtaatactagtagtatttgtgatattccctgttggtgaggttattccagagaatattgtattatgaatattgtttgcggtacttgttgctgattctataaaagaactgatactttctgtggaagttgttattatactatttgttatgttagtaacgttattaaaagcattgctggctgtagtttctattgctgaggttactgcagaggttgttgtattataaatatttgatgcggtatttgttgttgattctagaatagaactggtactttctgcagtagctgttattgtaccgtttgttgtgttactagtagtatttaaaatactactagctacagtccctagtgttgttggcatttttttacctatgaattgaaagaattacacagtatgtaaagttaactttggtctgctagatagataataatgtaatagtatgtaatcgcaaactccttcttgatttgttagattatttttactacatacccctaaaataatatgatttcattgaattgaaagctagttagttacttaatttaacctcatgcataacattatgtactaggaaaatgccaaatgttttaactacctataaaaacaccagtagcatttgttatagatatacactgaattttattaaaggaaactataacaaacactacttagtatttagctgtataagctaattgctatttataatacttaaagtatgcttacttgggctaaatttaattaaccctacacctcttattaattatacattagtatttttttaaagtaaaactttttctcgtaaaaattgattttttgatagtaatactcgttttgttagatattcatagtcaatgataacattattgattttgaggataatgcttagttttagtacatgtaagtaatgcttactatttatgtcgtaagcgtacattttttgttactaaagtttaatggtatgaaaaagtgttttttgacaaagagcttaatttgtgttgaattaagtgaagttttttatgctgagtaagatgaatcattgttgattttgcggttattttttatttcgacatgaaattcaacatgagcttatagcattttttcattagatttagtattgagatataaaaatgtgattacaaaatttatatattcttagattgttatattatttaacatgttgttattgaatacgtagtgtaattatgttttaaaaatattttttaaagaacagttaattcataattatattatgttgcctaattaaagaaattttctgataaaattttaataaggaagagtatatttgttattgtatgaatagatgcttgttttcagtgttgatatagtcaatattagatgttatccttaagatcaggattgttttgtatatatttaacatgaaagatgaactgaataaagtagttatttatactgatggagcatgttctggtaaccctggtcctggaggatgggcagcagttttgctgtttgatgataatgaaaagacaatctgtggtaatgattccgatactacaaataataggatggagttaacagcggttattgaggcactgaagttattaaaagtagcatataatgttgatttgtatactgatagcgtatatgttaaagatggtattacattgtggatcaggaaatggaaggttaatggatggaagactgctaataagatgccagtgaaaaacttggaactgtggttagaattagatagtctcgctaattttcataaagttacttggtattgggttagagctcatgtaggggatttgtataatcagaaagcagatatgcttgcacgtagtcagattgtcaggtgaattttatcatgtccttatgtttacatttctagaacattagatcagtgtagtaaagtaaatatatcttttgagtaatatgtatagataacaccgctgtgtattaatttagtgtttattatgctaaaaaaaaaaaagtttataagattattttttatactgatgatctctattgtgtgtagtgtatcctacctgtatgttcgtgatagagatgttatagagattaatgcaaaatttttgaatttttatgtaaaacataaacttgctacggtttttcctggttctgagatagatataggtagtactacgttaacttggcaaaataagagtgaaaattttatattatcatcacaaaatcttactattaaaagccctaagcttggggcaaatattacaatacctaagttcctgttatattctagagttgggatattatttttgtggggaaattgtgatttttcttatattgatattcctaaaatccgtattgagttctatgacattcaaaaaaaagttggaataaatcttgtagagaattctgtaaaaattcttaaagatatgctgttaaaggcaatcaaactcgatataccagtatttattagtaatgctattcttgctaaacatggtaaggaagatctaatgataaaacaacttagtgtcaaaatgaataaagggtatgataaaaatactattgattttaatgtcgaaaatgacaattctttcatcagtatgacagtgcatgaacactacaaaggtataatgtcttttgagatatcatatggtaattttaatactaaggtattaggatatttaggtaatttaaatgcaaagcttccgctgtatgataatttaaattttagtggtgatattgtattgagaattgatgaacatgatgaaattacatatggtgatgtaaatattcaaagaataaaaggtgttgttccttgtgtttcttctcgtaaatgctacatccatgattttaggactagattagtatatcaaaatgatattctatcagtgaaaaatttttttttattgttagatcaaagtaaaatagttgctactggaatgattgataacgaaaatgtggacttgacttttaattttgatgttatatttccaaagacgctgtgtgattactggtttgttaatttatatcctgatttaaatcgttggtattgtactaatgtgacagacggaaaaattactgatctgaaacttcaaattaaaggaaaacgcgatggtatgttcatctataatgatctttcaaactataatgttagtgcaaatatagaaaatgtttcgataaaattcaaccataattttgatccagtgcgtatagtgcatggtaaattatatttacgtgataatcaatttattattacttctgataattcggattttaaaggtgtagttattcaagatggaatattaaaaatagataatttaaaagatgaaaatgcagtgatgaccattagtggtagttctgtgggtgacgtaaagcaattatataaagctgtaaataaagatgaatttatactgttagataataacaaaatttttggtaagtctcatactaactttgattttaagatatttaatttactaaatgacgatattgtagattatgtatcttatatacatgcacaaattgaatcttttaaagctggtagtattttgaatacttttgatgtttatgatgctaaggttgatgttacattacatgataacgatgtgaatataaatactcagggttatatgaatggctttcctatgtctttgaaagtggatagaaatttgcaagataattataaatttcactatgaatttgcagggtatatttcagcggacaatataaaggagttaggaatttttgaatatggagattgttcaggagtaatgaagtcaaaccttcaatgggatattaatgccaataatacagtcattacaggggatgttgatctttctcagttaaaaattcactttgatggattaacacataataattttgatagtgtagtaaagttttctgcttcatttcaggataagaaagaaattaaaatagatagtgcatctatagttggtaaaggtgtagatatagaactcagtggtaaaacgggagccaatttagaattattattaaataaggtaaaattgaaagatacagatattacagctgagttaaagcggagtaatgattctattacagtaaaagtattcggggaatctttagatttaagtactgttgatttttctgagatgatgaaaggggaatctccgatgcaacaaactaaaattgatgtcaatgtaagtcgcgttatgatgaaaaataatgttgtagctaataatgtagatttcaaattaagttgttatgatactgtttgtaatgaaataaaattgacaggaaattttctagataatagtaattttagtttagagtatgggcctattggattagaaataaatactgataatgcaggggaacttcttcgtgcgatagatattttaaaagttgtagataaaggaaaattatctttctatatgtatccggtaaaagctggtgaaataacttctggtatgttttcattaacaaattttcatcttgtaaatgcttccattttggctcaaatattaacattatcctcactaaaaggagtagttaatacattaaatggtaaaggaatatatttcaatgcattgaatgcaccatttacttatcaagataacttaataagtatagatgagtcttggatagagggttctgagttaggtattagtttaggtggggaaattgatctaaatacaaagatgtttaacataaaaggacaaataattcctgcatatgtgattaataaaattatatggcaaactccaattattggaaagttgttaaccggaggacaaagtcgtggtgttatcgctatagattacaaggtaaaaggtacagataaagatcatgatttatcagtcaatttgatgtctattttgacacctaacttattaaaaagggtattaaaaatatttgatagtaaattgttaaaaaaagagcatgtcaagaaaagatcatctgttaataaggtaaataatcaggtgagaatggtatcataaaaaattttttcttgtttaggttaattttaatattagtagcacttatatagatttcggtataatttcatatataagatcatagttaatatgtgttgtatataaacgacgtgtcatgttattaggaaaagttcatgtgattgaaagtttactattaaataatcagcggaatgatgtctaaactacatgcgggaacggattttagtatattaaatgatgtaaaatacatattactgaattcatgtagttaagtaattgattgtaggaaaatattattatggtgaacttatagatatgaaaagaatttgaaaaattgatttttctgtttgtatatatgtgaaatgattttttgcgatatttaaattgattgataaagataaattaaatgctgataagaaaaataagaatagcaattatgtgcctactattgatcataataaatttatgatattgggaatttgtatattgcatctttttgtagctaagatataatttatcgtatctgtgtttgctatattttagttactagctaagaaaaggaaagttaatgagtgaggcctctgctactaaagttaagtattctagagttttactaaaagtgtctggtgaagcgttaatgggaaaaaaaggctttgggtgtgatatagaggtgctggataagctatctcatgatctcaaagaagtccatagttttggagtacagctgtgtttggttgtaggtggtggaaatatattccgtggtgcatcagcctcagcatcttttggatttgagcgagctagtaatgactatataggaatgctagctactatgatgaatgctttatctctacagaatgctttggaaaaagtaaatgttcaatctagagttttgtcagctattcctattactgctgtctgtgaaacatacattagaagacgtgctatacgtcatttagaaaaagggagagtagttatatgtgctgccggagtaggtagcccattctttactacagatactgcagctgcgttacgtggtatagaaatgggttgtgatgctatatttaaaggtacacaggttgatggggtatattctgctgaccctaaaaaaaatgctgatgcggtaagatatgataaaatttcttatcgtgatttattatcgttagatcttaaaattatggatgttgctgctgtttctttggctagagagcattcagtacctattattgtatttaatctgggtcaacctggtagttttgcggatataatccgtggagatggtttgtatacgacaatatataattaagttaaagtattggtataagtgaatgataagtgaagttaaacaagatgctaaaagtagaatggaaaagagtttatctgtatatttaagtgatattgatggtattagaactggaagagcaagaacttctgtattgaatggaattgttgttgaaacttatggtggacgtgtaaaattgaatacaatatcaagtgtatctgtatctgataataaaaccttgatgattaaagtatgggattctaacaacataggggctatcaaaactgcaattatgaattcgaatcttggatttgggatttcttgtgaagcaacaacaattcgattgactgttccagatatgacacaggatatgagaaaaaatttggttaagttattgggtaaaatttcagaagactgtagagtttctatccgtaatatacgtagagatatcatggatagattaaaggtcatgcaagatagtaaagagatttctgaagatgatttacgtgtagctggagtagaaatacaaaagatcacagatgatattatgaaaaaagtaaatgatgcttttacttcgaaggagaaggaattgttacatgtttaattctaattatggttttacagaagtcagttgctttgttttgatatttcaaagaataaatttttaaaaagttgatagatgcatgactttgagtattaggaagtactatcttaatctgaatttatatgtaatccttacttcataagtttttttttccataacccctaatatattctttatttaagaaaggtataagctgtattttaaaataattcttattataacaatagcgtattggcaatatacagttatatatgcactcctgcaaaggaatcagtgaagggagaaaaatgaagaaattctgagggttgtagtaccagacttcatgagttttttccataactccgtaatatattctttatttaagaaaggtataagctgtattttaaaataattcttattataacaatagcgtattggcaatatacagttatatgtgcactcctgagaggaatcagtgaagggagaaaaatgaagaagttctgagggtttatagtaccagatttaacatttctaattaatgtctaaataaaaacatcaattcgaactttttgtaataataattgcatactattaaacttgcaacacaaaataatatatattaagtacgctctagtatagaggataataagcataaagttttatattttttaatgcaatattcgttaatattagtctgtataaatttaatattatgtaataaagacaaataaaatgtatttagtttttctatgattttagttaacattatactaaattgtatttatgatataattggttgtttttattagagaatatcttgtataagtttaataataatttggttgaaacaatggtaagtggtaatttgtttataaggtcattgtcttctatattgatttgtgctgttgtatctttatctttgtattttggaggaatcgccttttatattttgtgtttttttcttgctatggtttcttctgttgagttgtttaatattatgcaatgtagaagattatattatattcctgcattttttatgatagtaataccttatgcatctttggtatatatttataatttattacatggagagataatcctgatatggttgatttttgttatttggggaacagatgtagctgcatattttgttggtaaaaatattggcgaaaaaaaaatagttcctatgatcagtcctaataagacatgggcagggttgtttggaggtatagttgctggagcgtttattagtgttgttatatctgtaatttttggaatattttttgtattccatgcatttatcgcaggtattcttatagcatttgttgcacaagttggtgatattacagaatcttatgtaaaacgcttatgtaaagtaaaagatagtgggagctttattcctggacatgggggtattcttgaccgcatggatagttttatttttactgcaccgttggttgcttattatgtccagaagttttctaaattttttctagcataatagctgccagttttttaattttttattacaatttttacgtttttttttgcatgtattctagttgtattagttaatactatagcatatataaatgtacccaattaatatatatttccccttttactgtttggttatttaagtgatcaaatcacaagcttaacttcatttaattaatagtagtgcaggatgttagtatgtaggttttttcctgtatacagttaattttttaaataaatttctagcatttattataattatatgtttttattagataaattacttaattttttaagtattagaaatttatttatgaggttttcatgcgtaatatatctaaccttttatatttctcttgttattcaaagttgggtgagataagtggaaggttatacagtatgcattgtgctagattagatgagaaaccagagctgtatagaccatttactttaaatgcaggagcattgttaagacttgctagttatgcttgtgatgctttaagtgaccaagctgtggtggaacgtgtaaatttagatcgagatgttgtagaaattataaaatttgatgtattgaatattataacttctttaattaaggtatataatagtgttattgatatgcgtattcatcctgaacaaacaaatgatttagtattttctgcaaaattgttattacatgaggtgaaaaacactttaaataggatgagatgtttatgccagaaattaataaagtatagtaatgtaattgcaagagatgattttttgcatatgtctcttgctgttcataatcttgattttttttcttataatatacaggagtacgttgacgatataaaatctgcaatatcagagccgtgtaggtcaatgagtatggcaagtgttcctgctacagaacgagcaaaaatatcaagtgaaaattttaatatattagaacccttagattttaataagaatcgttatttatgtgatttgaaggataaagctatatctgaattagttccagtatatgatgaatctcttactgacttgggacttagatatggatatgatatatcacttttgttcaaatctgttatgatatctactcaagagtataggcagcctttctctaaaggatcacgattagttatattaaattgtgggagagtagcatgcattaatgatctaaaagatggctttattttatataataagtttatagtttctttagctgaaggtggtgttgtttatagtacttcctctaatataggtttaagagagttgtctggttgtgatcaagaagctcaagggagggtttatagtccagattctgttttatctagtagtgatgaagaattgataacttctttgggtagtgcagataaaaataagtaatatgttgacaggtaatgaaacactttttttatgtaattattagtactaattttgtgattactaaaagattattacaacatttaagccttttgtttttatgcattttcaaaataaatattctgtaattttatatggttactgttttgtaaatatatgattagtagtattttaataaaattattaaaatataaatagtagtatataaaatatttttgtattaaaactttttctttagtaatttgtttttaattttgcatagatgaagagtttattggtgattttacatattaagtatagtgttaattttagcaaatagtaaatattttaattaaaaaaagtgggtattactaattagctgatatttaaatgtaaattatgtaaaaaagttaacctaaattatataactatatgatctaaccataatatcaatactatttttgtaaaagaatagtaataaaagatgttttttttaagctttttcttaatatcttgtaagaaaaattaaatagtactaaaatatattaatatttattattaatttttaggtgttttatggctgacaatctaagtaaaatggaaaaaaccttaaatataattctttttattatactttttcctattatgttaccagtttttttatatattaagttaagtgaaaaaattaataaagctgtgtctgtacaaaaagagagaagcaagattagtaggggagcgaatagatatgttcaaggggtgttaagtaaatatagtgaagatacgttaaaacatgatagtcgtgaaagactaaggtttcgatatgcaacttctcttattatgcgttcattatatagtattacaacagagcattatagtataggtaattatcatgattcagaacatttgagcgcattagaacaactagctacgaagatggtcataagtcgtggttctataatgagagcttatgcatttgttagtaattctatacgtagtggtcaagaagattgtgattctgctgatagtattaaagaaataaaaaagactatagcattattcgaagaattatatcaaaatagctctgatttcatgagaaaagctgatgccatttatgcggatgttaagggctctgaagtctgtgagagagtattaaaaatgcatgacgcaagtaaagtggtgaaatataatagtgagttttgtataaaaaagcttaaaattatgttaaaaaatgaaattgctgcagcaaagcggaacggtttatgtaatactagtgttgatggagtttctaatcctggtttaagtgctgcttaaaacattgttttgtataccatacatgaattgttaatggggctaaagctccattaacaggaataatatcataagaaatataatttatattgaataattttatatgattcatattcattatttgagacgaatttgatgtgtataaaagaaaatgtgcttaagaaactatgaatactcttgatgataattataaagtgaggttgaattaaattataaatgtccttatttgtagtaactatagtaatttcaagcaccttttatttatgtatttgatatatttagatattaagaataattttaagtacgttaacctgtagtaagaattacataaattgaatttttcaatattaaagcacccttatactaatatttttaacatgttctaaattaatgtaaaagattgtaaagtaagataacgtatgattgtttagtagctagattgttagttagtgtaaatttaaaaaagcatttatgttgcttaagtgttagttgaaatgggcgattgaagactaaattataaatgattatagtttgtatttataaattttatttaaatttattagattttaaattaggtagaagaatttttataaggtaaattctattaatagtttatgatattttaatagtttgaagaattacataaaagatttctaaagtgaaccgttggatttttgtagcaatgcttatgactttagtgtaaaagttgttctatattattaatttttaactttttgaaaattttagtacatacttactcagtgtaatagtatatttgttaaaaatctggaagtattaagtaattgttctattagtaagctgcatgaatttgtaaatgtatagtttatcctaaatattctcgtaaaacatgtttatatgttttatcttaaaatcatgggttttagacttgtcttagacatgttattctaaagggaaatggaatttagaacaaaagatttatgaatgtgttttcttttatttctaggtttaagcaactttttcgtattttaatgttttattattattgtatgactttatgtaatataattttgtaactttttcaatatttttgctgaagtaggtgttcatattactggtggattataatctgtgattttgtattctgctcaatggaaaataaagttgattattgtataaaaataatctgagatattgtgtgtaaaatgtaaaatttgctagatactactaaacataaacaataattcttattattaatcattattaatcagttatgaaattttatgaaaaactagttatgaatatgtgtggatagtattttctaggatgatatggagcaatgtaataacttgttatctaataatttctgcatatgtttttgtgactgatagcacttaataacagggtattttttgttaaattttatttaatattattagttaatatattaagtatatatcatttagtgtagttattaacgttagtagtgtgtaagtttacttatattaacttatgagtttgcattatgaaatacggaacttatttagctatggctagtcttttgatatgtattatttttgctttaatgttatatggtatattgaaaaagtgtagaacttctagagcagtactaaatggagttgatacattacctaagcatgtctatagtatttctaatagtagattacataattctattctttgttacttaaaagtaaaattgaaagaacagttaaaggatttttgtgatagaaataatgttgaatgtataaaagctgagtctgctcaatatggtgttttgatggttaaagttggatttgagtatgtgcagcatcaaatggcttgttttattagtgaaattcagaatgatgatatttataagaaagcattgttgttaggtaatgttatttctcaatctgaaaacttaatatttgcgtacagtgaataccgatatgctttgataaaatgtgaattacaaaacatattgtacgctcgtatttcattaagaaatatatttaatctagtaaaagatataaaagtaaaagatcagattgagttaatgaaaacatatcatgcaaaattagattgtggtttagcttttattgctaaaggacttggttttattatgaaggatgttggagtgttagatgaatttgatagtattcgagaactatgtgatgatggattcttgtatgatgatgactatttaacttttacttcaatatctttaaaaagtatcgaaggttatacacattaaaaggtagattttttaagatatattgattgataatgggatgttgacttattctgaaaactatttagtatagtgaattctataatcaagtaaagattttaatatatttctgtatgtaaggggtactgtctcatatagtaaatagtttttattttaataaaaattattaatattagatatgtatatcatgatttgaaagaaaagttgtatggtgtataaattacataattaacattaatcagagttattttgatgtgatgggtaatatgatggaaatttaagaaagttattgtacatgcgactgtgagttgtgtagtttttttgtaaaggcatatagaggttgtgtatgtctatgttataagtacaggaagttataagttgtatagtagtcatatttgtgaatgtgggcatcgttagtattaagttcatatcaagtatcatgacttgatgtagtatgtttacttttaatgagttcaagagaaagtctatagggggggagggtggcttgtagaatttgattttaggtctttaagatctttgagagaaattacagtaacttgaattatatgtaaatgaatcctaatttggactttaaagtaaatattgctgctacacaactttatttttcgatatagaatataaaaggccaatttacttaatagtgtgtgctaataaaggtataaatattaataaaaaatgctaataaagaaataatttatagattttttctcaaagttattttatgttcttagaaaagaaatcagtgagtttgatagtaatgttttgaaaaaaatcgatttttttactgcggttttgatgttgatagcaatttttgtaatgcttttaataatactgatagtttcttataatatatgttttagtagaagcatgtcaaaaatttatccagttgttcagaaagaggtaagtgttatgcttgatatgaaacttcaaggagctgatccgtcacataataaagatttcttaaaaattactaatgcaataaattatatacgagaccaaataatgttattacggtgttcttatccacataatttgagagttcaatgtgcaatgttgagtatgttttgtgtgagggcaaaagcacgtataatgggtttgtatcaaaatgaggaaggcttcagtgcagaggaaaaagatgagttatcaagtttacgaatgagtatgtacagagatggtatagaatatactacagagtctttgcaatatgatattattaggttactacagtctgtagtttcttgtattaacggtttagtgcggggtcatactttatttgtgtattatgaagaagaacagtggattttgtgccgcattaaagcagcatataaaatttgtcaagaaggtatgcaatctattaataaagaaaaaacagaatatgtacaaattcagtgtttattagctcctacattaggatatacttaatgtatattatttttgttgttgtaagtctaatagtatataattgttatttatattatgtgaaattcgaattcatgttttatttagacattaagtagaaatgttaaatctggtattacaaacctccagaatttttcctttcctttgctgattcctattctaggagtacatatataattgtctatattaatgtctgtgttacaaatacagaaattgtatttttgtgtaatgtctgtattattatgttcttttgttatttgtagaattttgcatagttttcctggaccattaataatagtattaggtttattttcagataataatactattcctcgaatgagtactgcagcagggaatccttcttgttcagtaacaacattaagacagtagtacattccataaataaaataaacgtaggaaaatcctgggctaccaaacattacagaagtgcgttttgtatagccacgtgcggaatgtgcagctggatcatcctgacctatatatgcttctgtttctgtaataataccttgatgttgattaaacagtaatttttttcctagtaacttgcctgcaacagtaagtgatgattgttcataaaaagacttttttagtatataatgtggcactgtgtatttttactagaaacggcttatttatactatactaatagtatatattatattgtcaataatgaggtttcagaatgagtgatcaggaaaaaacagataccagtggtaaaaaagtggataaattaaaaaaagttcataatgcggtatccaaggttgcacaatttattgtaggggagagtttaagtttacagcttaaggagtataaggttagtttttcttatattgttgataatactacagattatttgaagttaactaatgtacaagaggtaaaaatcattgaaaaaatcaatcaattgaagaatattaataatactctgttggagaggttgtttaatttttggttgcgtaggaataaacagctactatattggcatatgatttttttattggttaatattatcttgttgattcttaatggggataatctggttaaattatcaaacctgatagttgaaattcttatcaaatggaaggatggagttgtctctctttattgttcttaattttataattatatgttgagaatgtagatattttggtattaagcatgttgctgattattttgaaatgaatattttatttttgttaatatgatgaatgttatttttttactataagatatttgtacattctatataactgttataagcatagtatgctaactggtggtaggataatgtaatatacacgtaaatattgtgatattgagtatgtatttaatgtattagcatggtgtttattatgtgtgatatctgtattactgttggaattttaagatagtaggtagtaattcttgttttgtactgtgtagtttatgagaaatgagtactgtcaataataagtaacacaataacagttggtattgtagtgttatttaaaaaattatgctataattagcataatttaataaaataataacatttcagtataagttattgtttttttttatgatgagtaacaaatcctcagttgttgatgtattgtagaaataatagtgaatctggttctggtcaatgtggtatggtaaatgttacagaaagtgcttataccaattttgctgaacaaggcttagcattaagtgaagatatactattgatataataaattctagcgtgccagcaaagagttaataatgtgttataggataatgctacaggagtaaagtaatataatgcagaaattttttgaagatttaggaatacgataataactataaaattctataagcccattatggttacagtgtagatcactttaaaggcttataaagatttttttgatatggtgaataatatgaataagtgtggtgttattaaatcatcctccttgtgtaagttctgatattgaatgcatggacaagacattatctattatatagaaagatattgtatttaataagaatactatatgctagaatgtccaactaaaagtatctagataataatagtttgtctactgaattaggaattgactaactaatgatataaaaaatgtgggaaatttttatacataagtgttgtatttttatatgtggaaataataaaaatgcatcatgacaaacaaatttgttttttgttagtaattattttatgttaataagtcatgtgtttgactaggagcagtggtaatattaaaatattgataatagttgcttttggtgtcaagttattctataattaattagtatcgttctttcgggtacgtcatatattcaatatatctttattagtgttcttataaagaatactttttaacagatatctaagtaatacataagtttctttgattagtgtgttttaatatattgggggttatgattatgtcagagggtcttattgttgtaatagcattacaagtttttttactcttgctattgtttatttttgcgctctatcattattgtattaagccttgtagcaaatcaggcaagatgggctatgagcgatttgaaggtgaaaatattccaaaatacgaaggtgtgcttgaacactttgaagagatggattatctccagttacaacaacgtgttgctgaattaaggcttgcttgtcggatgttagacaaagaaagggtgacaaatgaccgtacttatgaagagtgtttggattggatgttttttgtgtctctgactcttgacgaactgatggtagagaacaagttggaatctgactatattacacgcatgcgagcacaataccatctgtttaacctgagaataatagcagaccaagttgctagacaacctgcagctaatgtggaaagacaagaagatctacaggaggttgagcaaagcccaagtcctcaagtggaaggtacatcagtagcgtcttgttgtggtcaagagaaacaagcagcttaatgagttttagcatatgtaaatccaaatgtttagtatttgggtaaggtattgactgtttaaataatcaaatttatgaatatgtagttgagagatttgatttctgctgtagtggtattattttattaaaatttacatatttatttttgttaaagttagaaaaatagagaattatttaatataattcgacattattgagctctatagtgagttttaggaattttagaaagtgaagatttgaagttattgagggtatatgattgtttaaatattttcaagtttatttattgctagtaaagtatgttgtgatgctcaagtattaccggtatgtaatttgtgatatgcttattacatttccggaacttgttaataggtatttaccataagactaataagatctatgaacaagttgtatgtaacgtttctcaaaatttaaaaggcattttaattgttaattattaaaggagattattcttaaataatgaagcatttataagtactaaatgttgtggacttttgtgattatagtaggtattctattgtatatttaattttaatacttaagttatatacttttaatatgtacaggagcaggagaatactgatataatagcaggatttttctaagtgtgtggtatttctacttataatatcaatattaatttatattagggcatgtatgggtactggagcaattattggtataattatagcaatacttttgttaattcttattgctcttgtattatatgttttattcaggacgtttttaaggcctgaattatatgtaaggtcaaatctttttccaacgggtgtggtgacaaatgtagacccagaaagagatctgcgttcatttattatgatggattttgaacgtcaaacagcagctaatatggtttctattgtacgagatatgaagtttcaaatatcttctattcggtgctatagagatatattatctagtctcatccaagaagaccaagatacattgcaaccagaaataatggaacaaatacttgaattgatgtatagagctcaaacgattgatgagcaaatacaggataggctaagtagcataggacaatttacattagacatggctaatgcagaagatattgcgtgtgtaacttgtaattatgaagcattgtgtaacattggacaggaaatagaagcatgtattcactcaatatttgatatagaagtgaatagaacaacagttgcagcatatactatgagcattcaacttattatgtctgaagctacacgaaaattgtttgttttggtaccaataagagacctagggttacctacagatgcctcgcatagtcaggcagcaagtagcatggacagataaattagttgtttaaaagtatttagtatagaaatttataagggtagaataactgtatgttgctgtatattgtattaggagcaatttgctattaaatcagattcaatatatggttggtatgttagttgaaatatgtatgattaaacaaatggattacgtaaaatagattacgtattggttaatgttatctgttgtatagagtgttaatgctcaaggagtgtttacaattcataatacagatctggaattgtatgttgtaccttttattatgtctgaatctagctaaaaattatttgttttgacatcaataaaagaccgagatgttacctacagaagaaggctcgcgtgttcatatggtcagggagcaagtagcatgaacagataaattagttgtttaaaagtgtttagtatattgaaatttataagggactgtatgttgctgtatattgtattaggagcaatttgctattaaatcagattcaatatatggttggtatgttagctgaaatatgtatgattaaacaaatggattacgtaaaatagattacgtattggttaatgttatctgttgtgtagagtgttaatgctcaaggagtgtttataattcataatacagacctaatatcgtcattgtatcttattgtgaagggtattttttatctattttgaggtacttttataaagtaaatattggttaggttgtatattatatacgaatgttagcttatagattagattttatttagtgtattattggttgttggttagcatgtatctgaaaatagctaatagtataatatattactgcttgtatattgtatttttcttattaagggatgtatctaaggtttgctgttctgagataaatcgtatgtatttgttgtggattgaatattagggatatattctggtagttaatgttatatagactcattctttttttgttggttcagccaaagattatttgatagataccagtctttacctatagatttattgttctctttttgttgcagcgaattttaagttacgtatttctcaaattggtgtgtaattttttgtattaacaattattgctgagtatattgttttacctaattaattattaacgaaaatacttattgcagaggggataatttactacagatatatcttgctataaaagtaagtttttttcttatttaaagaataattttaaaattttagttaaaatatgctatatacaacatattttatattgcatttttaataaatgtagtatatatgctaattatagcataaaaaggtttataagttatgacatcgaatgtgttaataattagtatgataatagtagtattactgattttttgtgtgatgttactatgcctcataataatctgtagtcagaacaggaatgctagtttagtagatgatcaacaagatcctgtcttatatgattttgaagaacactgtagcatatcttctagttcgtgtcatactcagagcgatagtacgctttctgaaggtgaatctgtagatgaggaacaggaagtcgatgatacaatgcaatacttgagtgactgtgatgactttgaaacggatagccttgagatacacgatgatagtagttcaatgaatcaaggacactgtagtttaggtgctatacctaagacttataatcctacatttatgcaaaaaaagactggatggattgaagaatctagtagtagggaattctctgatgaatgtttttcatgttctgatgtttcagatgacgatatgtctactaaaagtagtatgttgcttgattatgactgtcagaatagaaaaagtaatcctaatcatgaacttgtggtattgcgtactgataattctgatgtaagtactgtaaatgtcagtcgtgtaatgccaaatgggcgcataaggttaaattcattaggaggagaaggtgatcatctgacatcttatacatttggtttcccattacgttccagtagtaaacttgtgttaagtagttctaatcttagtttttcagagttgataataagtcctactatatatgcagaatttggtaagatagatcccttctgttttagttattttgaaaaagatatgttaggtagaatgggtggagtacctagttctggagtttatggtatagaaagtcatgcttgtgctaacagtttaatatcacaggatgccattttgggtttacgaacttgtgggaaattaaggaaggatacagtttttgttgttaatcaaggagatttaatagatatgaaagatcatatttctaatgttttacccagtgatgttaaacctggaatttctagttctagagagattgtaggtttaacaagtggatctgaatgtactgaagagaattcacaaaggattgttcaaggaacaggtgttagtgtagtggaggatgcagttccttctggatctagaatggtgtttgctagtcaagatgtggatgctatgtttgcaagtagtgttcagattattcaagatagtatggatttgttatctgatttttgtttggatgagatgactgatgatgaagttgaacagataacgcgtaatatggaacaaagtagtacgtcttgtgcaacagtttcagctatggcacagatggtaggggctagtaatgtttctgatggagctaatacagatgttaattatctatgtcaagaaggaaaggacagtgcgggattgttgctaggagaaggtgtatctaaggataagaagatgacatctgctgcatcaagaaatgtagtagttgtacaagcagaagtgcatgagccgagtactagtagttctgttgttcgcaaatctagaattccaattaaggttggtgagtcaagtagagtagttacgaagaaaagattggatgttaagcaaagtagtttaagtgtcacgtccaaaagtcaaggtttaggtgtgagaaagttacaagcagtagcagcagatgatcgacctaatctggttggatataagtttaaaagtggtgattatatgctatgtcagtctcctaagtctaatcgtgctgatgtaactaaacgtagagtatctcagagcggtggttctgtatcagtcaaaccttatgaacctgggcatactagggtggcagcgcataaagagtctcaaagtagtgatcatgtctcagttaaaccttgtgagcctagacgtatagttccgcaagtaacggtagcactaagaaaaaaacgagtggtttttcaagatacagggaaaggtgaagctgtgctcggaaggcatggtagtacacaagaatgtgtagagcctagcagcgtaacaagaagttctctggagaatgttcctaatgttgtgaaacataagtacgaagatgtttgtcacaaggattcacgtcatgatatagcattaaggagaagtgtatcttctgtccatcagcaaagttctaaatctgctagaagtatggctactctaggaaagagatctgcagctgctaaaactggggtaagcgttaggaggactaaaagtgatgctatagatactgaaaaagggcgagataagcgctggttagaaaatgaaattgctattccactagaaaacactgtaagccaagtagtgatttgtgggactaatgaaacattacatgatacattaagtaaacattttagagtactacatgattcattgtcacaatacagtaagaattcagatgctgttgttcgatgcaaagaggtatattatatagcacattcacgcattaaacatgcagatagtattatacaggaggctgttgataaatgggcgttaacgcagagagctacactgtgggataaacatgggaaaaaagtagttactgcgtgtatgaaggatttggagaaagtttttaagaagatttatatagatcaaggtaaaacttctcttgattgtcaggcaaaacttcaggatatacgtagtgaagtggagaacaatgtcaaaaaccaaattgcttgtttagtgagagatacattcttaaaaaatgcatgtgatgagatttttactgaggtatcatctactatacttcataaagtgtctgttgcacatgagtcaattgttaaaggaatgagaaaatgttcgagagaagagctggaaggtcaagtagtaaagagttgttctatattccataagagtaagttgcaatctaaaatattaactcatataaatgatttaggtacattttttaagaaacaactgcaagtaaaatctaaggaaatagtaaaagaacaattgaaaaaatgtaaagttgatattgttcctggtgatattaggcattgttgtatagatacagtaattaatgctcctgttcctaatactgctgctagatatgcaattcatgtattgaatagtagaccaaatgttagtgggcttgatgcaggacaactgagttttagttaataattttagatattataaaagcatcagatcttaaaaatgatactttttattaataatattttatatttattataaaaagtaaatttttatatagatcttgatgcttttttatgttacgattaatttattaataaagtaattattaatttaataattattaggcttttgatgtttgcagagtatattgtagatgtctgtggtggtttgaaggttatattatcgtacgtttacctatttgatatctagtgatgttttgtagtaagtgttagttagaaagacttaatgattctatagttgtagaggttaaattctaatattgaattagttatggtggtttaaaatcagggttaaagtaaatcactggtgctatttatacatcatcttaattaaggtagtggaaatactttttaaaattaatctgatgtaattgatagcataatgttgactagatcaaatgatctactgtttttaagttaatgtgcttgataatttgatatgtaaacatttctgtttgagccagatattaataaagattattggtttttatatttatgtagtgagtttatgaattattgtaatctattagaagtggtaataataatactgttaatgataatgttatccttgttgatatatgtaatgagtaaaaaatgttatatgactgctgccattacagttggggaaggtgaagatatacaatcagtacaagcaccagaaagaaatttgagcaatggtgttagtaatcctagagttgttaatagtattgattctagtagtaatatgagtgctgatagtgctagtgatatgggtgctgatagtgctagtaatatgagtgctgatggtgctggtaatatgggtgctgatggtgctggtaatatgagtgctgatggtgctggtaatatgagtgctgatggtgctggtaatatgagtgctgatggtgctggtaatatgagtgctgatggtgctggtaatatgggtactgatggtgctgattctggtagtgatatagatactgataatagtattggtagtgatgtgatagaaggaggaacaagtggtgatgaggaagaagagttacattcagtagatcagcacatggtaaatgttggtaataatggtgtcatagcagtagaaccacaatctagtatttgttttagatagaattaatattgagggatgtgttctaaagtcgtttaatatgacttgcaatactttatagtctcagagcactaaataacaactgtttttggtatgtatgtaaatgtttctgtaaacaaagtgttagtgcttttatacttaagtagaaataaaatagcagatcatatttatgtgtagtttgagatctgaaatagttaatgaaaagtttttagaatttaatatattaattttatgtttatgcggtaatattatgcatacagtatgtaaaagatctcaagtattctttttgtagtaccatttatagtagtactgttagcaggattggtagttctcatatgtgtgagtgtgaactattaatcactagaagaaatgttttaggatagtagatccacgcaagcgaaaggtttgtctagttatgttaatagtagtaatgctgcaagaaggatgacaagtgataaagaaaataataatgttcttgaagagataggccatagtacggagttgaagtctggttatttaggtcggaaagtaaccaaagataatttttcaaaaagaaagccttattatttaagcatagaattacacagtttgtgtggtgctaaaagaaactagggtgtgctatgctgtttgttatgctatctatgtgttctgaaaatttaaacatataacattcttattaaatcaagtatttaacttattatcttttacaatagcaagtagagatagaaatgtattggtatatatctaggatatagaaattaattttcttttttcaataacgttatataggaaaaagtttgtattgtttgaatagactgtttttaggggtttgttgattataatattatagcatatagatgttatttttcaatatttttgaagaaagattaatatgtatttagataaagtttagttctgatattacatttgttaatattgttgtggatttctgttgattaaaaaagcatatattctagtagtaaatttcttgcagaagatttttaatatatgtaaatttattttaagagtttttaatatagataaaaaaattaatatattagagacctttttataagttttatcaaagattaatcctgagttagtgtgtattggggagatgatggatttattatagaaaattttaacatgtgggtagaaagtcatgattacgaataggagtggaagtgataggttaaaacctggtgcatttttaggaatttcatcttgtgttgatcatagattggtaaggcctggatatataaagaaaatggtggattcattaactctagagagacgaaaactagaagaggctagaacatcattaataatgtatgagtatagtttacagttttacagtttgctcatcctattttttaaagtgttaagaaataactatgggtcaagacaaactttacagaaacatattgaaatgaggggtattactaccttgctaaagaataaaaaagtgttgcttaatgatgcttttgctaggaagtttattaattgtatggtgaataaagttgtaggatttattatagataaaaagcaagctcaaaagttgtgggttgagaaagaagagtatgcgagggaaatttgttataaagttattaatgatataaataagaaaagaaaaagtttagatatacaaaatcttacagaagaggaaatagtttctcaagatgataaaatggatgaagcattatttggtgcttatacagaacaggttagaattttttctgaagtgaaggatcagcagcaaggttttaatttcttgaaatgtattccttctttatcagaaatatttgatgctagtgatgttttgagaagtagtgagatttgtagtagcataaggagtgctgttgaaatttcgcgtgttgatgcaatagaattggaaatgctacttaagtatattattttgggaaatagtgttgatgtgataaaggtgaatttccttttcagtgccttaaaaaattgtttgaagaatatctattgtaaaattgctgaaaattttgttgatgtgcgagaatctaggtcgtctagtagtgatatacatcaagtgcaattacatgagcaaattggtgtaatatgtaagaatcttgttaaggtttctatgccagcagaagatatatgtaatatgtatacggagatttattacacattatcattgcgttttaatatgataagtaaagaaatagaggacttattaatagcagtatttataggtaatgaaaaaggtgaggttgaagaatttaagaaaaaggatattattagatctctttatgattgccaattgaaatcaatttattcaataatagaagcagattgttgttgtgctgatttgttatttgtaaatagaagggtgaaatctgtaataatgagcctttgtgtgcaaagagatgatattatagatcacatgtctaatgttgaaaagttacttatttctgctgctaagtaccaagatattgtagctgattttgtctctcatgatgttcctgtaagtaatgaagatcttttattaaaatgtgataatattacacaattaaagaaaagtttaaagtcaggagagagagtaaatagtagtgtagccacaattctgacagaggatttaggtgttatagatagtcaaatacaaaaattagaagaaagcttgaacatgttaatatcccggagatgtgttagagctggttcttgtattgtatgaagtagattatcttttgatgtttaaagtttataattctgtgatatgagttagtgcaactttagtgttataggatatgtgttttaaggtataatgactttgaatactgtgaatcatattatgaaagtatgtaaataataagtttggaaatttttgtgtaaagaattgatagaataaatcatcagggatataaggtatttgtagataaaatttgctatctcttaaaagtaggtgtttttaattgttagtgctaaatgctactaaagatttggtatggcatttaatttatgtgctacttctctatatccttctattacatttcctaggttcaaacggtaacgatctttgtcaagtcttttgttagtagatatgtcccagagtctacatgtatctgggcttatttcatctgctaaaaataaatctgattgttcatcgttgtgcaatttgccaaattctagtttgaaatctactagtttgattccaacgttgaaaaaaagctcactgaggatattgttgatctttagagatagtatttttattttctctaactcttgatttgtaagccattggaagctcagaatatgtccctcacttaccatagggtcagatagctcatcatttttataataaaattcaatgatgggagatttaaaaggggtaccgtctgctatttgaaatcttttactaaaattaccagctgctaaattccttattacaacctcgattgggattattgttattttttttactagttgttctctttgatttaataaagatataaaatgtgttttgatacctttatctataagttttttcattaagaaactgcttatatagttgttcaatatacctttttcatggataatagctgcttttttattgttgaaagcggtaatctcatctttgaaatgttgtattacttctagagggtttaacgttgcaaatattatttttgcttttccttcatagattttttctttattttccattatatattacaaagtctattaaactttcattttatatatttgtagttaatttagcaattggctttttaagttttaagtaagtgtatagtgttatcattattctagaatatttaaaatgtgtgttaattaatatggtaatatgtagttcgagtataatacgagtagattgatgtaaggtagagttttatgcagcgtgataagttaagagaagtaaggggtaccaaggatctattagggattgaactttataagtttcaatatatacatcgtttatctcagtcaatagcgcatagatatggatttatagctgttgatactccaatcattgaatttactgaagtgtttactaagactttaggtgatgattcagatattgtaatgaaggaaatgtataattttcaggataaaagtggtgaaaatattacattaaggccagaatttacatctgctattgtgagggtattaattaataaaaatttaattattcctgtcaaattattttctagtggaccagtatttcgttatgaacgtcctcaaaagtgtcgtcaaagacaatttcatcaagttaattttgagttttttggaagtgatcttcctcttgcagatattgaaatgatagcattaggctatcatattttggatgagttgaagttgttagatgatataacgttagagattaattttctaggtgataaggaaactatgaactcatataagctcagtcttatagagtatttaaacaaatataagaaagatttatcagaagatagtcagcgtaggcttattacaaatcctctaagaatattagattcaaaagctccagaagatcgtgaaattttattgaatgttcctaatatttcttatttttatagtaaatcctctaatgatttttttgcagaggttctatatgggttagatgagctctgtattccttataaagtaaatcatagtatagttagaggtttagattattattgtaatacggtgtttgagtttacaacgtctaaattaggagcacaaaatgcagttgttgctggtggtagatatgatggattagtgaagtctatgggaggaaatgatactcctgctgttggttttgctatgggtgttgaaagagttagtgcgttgatagattataaacatcaagaacctaggagtgtagtattgatacctatagggaaagatgcagtatcctatgctttgaagcttgcttatgagttacgttgtaatggtatttctgtaaactggaattataaaaatgctaatttgagaaatgcattaaggaaagtaggtgatgataatatagtgttaatttttggagatgaagagctaaaaaataatactatacaagtcaaagatatgaaaactggtgaacaacaagaaatagttagatgtgatttattggacacattgtgtaacaaaatttaacagtgtttgtcaagttatgaaaaaagcgtaaggatttagttaaaaaatttctatttttatttaaatgtgttattatttaaagtacatctgaaaaagaagagagtgtctttttggttgggaatttatgtattgtatagacacaatgtaatcattttctatttttcaataattctaaagtgggaggtatagcatgttaactaataagtttaaacaaagtgctgtgatggctcataacatgagttatttagcatatttttgtagaagtatgggattgtctagtgaagacacattaggattattgacaatactagaatccttccatcaaaacgcagcttctttcctgatatatgatttggacagatgtaatgttgaaagcaatgatcatatagattttgtagtgaaagattgtgatcataggaactatagatgttatgaccatgtatcacaacaattagagactcaaggtcaccttgagttagcatctatgacacgtttgtggaatgttcaaatgtatttactgttgcgtcttcactctcttgctgctcaatatgtactgtccacacggcattatactgatgacgaaatagtggaaggattgttatctgatctaagtcgaacttgtatgtctattatgactcggggaaaaacaagttcagtcactcctgaaaatgcagaagcactaaaggtgtatggtgacaagtttgtccagagactttttggaatacagactatggatatggatagtatgcacagtatattgcatagtatgatctgtagtgttagaggtagttacttacaagttatagaaggcttagataaagtacaagacaaagaaacgcttatgaaactagttactcttgttgtgtataagagtgctataagttgttttatgaacataaatcctgattttttcagccaaacattgaggaaaaaagcttactctgttctccatggatttatttgtgatggtacagacaaattacctatatcatgtagaagtcgtcttggtatgggcatggcaccttcacttgttcttttttataagaatttattttctgtatttcatcaaggaagtatatctgattgttatggtgatgaaattaggtacaacatatctgtatttaatgatgtatgtctggcaacaagaggatcgttagctattgttgctaatgagcctgtaccatacaatccgttttcttctcgtatgactcattttgcttattatgacgctactttggcagttaatgggatatttcatcacccaaaacttgataatgtattgaaattggaatctatgacacaaatgtacaagatgtcattagaagggaacccatcagacttacactgtttgtttgtatcgggattaggtaggatgaatttttcctttgaagataaaggagagcctaattctggacttgagatgttatgtgagttgctgtctatgtgttactatgctgtttttgttgcaagacagccattgagtgtagttagaggaatgtttaatatatgttatgggaaattaggtgatcttggtgataaggtaaatgtaggaagtgttgcaggaagtaagttagccattgaaagttatagggatgcttttaatgctgcacaagcagcattacattgtactggaattaatccttcagacgttatttttaagaaagaaacacttttgatattagtgcaacatttattattaggtgaagttgcgcaagaaaagattgaggactcaaaattagcatttgatatatttgagttatgtaaaccagtgaatgaagtaaaagctcagcaagcagcaatgatgatgtgtcaggcattcaggggatctaatggtgttgtagatggttatgaagtaggaaacttgggtgcaatagttctaaaattgctttttggtaattttgtagaaagaaacctgattttaaagttgttagatattacttgtgtagcttgtgatcgttataaaatgcagggtgctgtacaggatatgtacaatgagttattgaaagatttcatgtcttgtgctgatgtttgtttgagtttattcagatatgcaggtagttctttacctatgtgttatagttcgcaagtggtggcaggactagacggtgatagttgtgcagtatacagtcaaatgtacaatatgttatcatcctatgcaagtaggttaaatgtatctcaagatgatcttattagggcaagaaattcaagatttagtgttagctttgctgagctgtttagtaatgcggtattaccacatggtgagcaatctggtccagaattgcaagttaatccttgtgatggcataagtaaaccagagtccatggccttggtacagatgcttgcatcttatgtgtatttatataattcaagtgagataaaagaggagttattgtctgcgaagttatcttcaccacagttcttattctctattattttggtctctcctagatttgctgctaattttataaatatgtgttatgaatcttcgacaaagaaagattattcacctcagaaagctgtaagtgcgtttcttaatcgtattagtaatatagggggatctaggacatctagtgctgaagctatcgatataatgactggtcaaggtaataatgttattatggaaaattttattagatcatgtgttaacgaagatggcagtattaatgttgaagattcaatacttagggcagcatgtttatggattataaaatcgaacaatttagtacataaagatgttatacaagatgttgatgatgctgattgtgcaggtaaagttagtccagttgttatcgattctgtgtcattatctgaagttttgctaccggtattatcaaatccattagctctagatgatccggaaggacctgtgtcattttctcatctcgtttatagtactggtttattagataaatcaggtattgagagtgcttctgcgactgtaggtaaattgcagatacaaattcaggtggatgcgaaatgtgagacagatgtaaaagaagtaggtcctagtgatgataaagtcagcgagatagtagaaatgaaagatgacgtccaagaagtagaggtggaatgtaaaacttcggacactcaaacagtagcaatagaagatcaaactcagagatatgaagattcttatgtcgcacgtgatcctggtgatgtgcaatcaagtactagtgacatttttaaagagaagaggtcttcaatttgtaattatgcatctgcaatatcagcagctatacttgctgtttctcttacattaatgggaatggcttttgcggtaaatgatgaaggagcacgaatagcatgtatcgctttatctatgacttgttttgttatatcaatatcaatgtttcttatgacatgtataaacatccgtagcttaaatggacgtaatgaaggtcatgatgatgatacgcaacgcatactaaataatgaagttgtaaatgaaacacaagatgcaacaatttttccagtagacattaatacacgtcctaagacacattagaaagtcacattctgctttaaaaaagcctttatccttgctcatctattttacttcttaaagtagatatatcagctgctccaccaataaatgtatctcctattataatggcaggggtgccccttatgttaatgttttgagctaattctttagtagattgtatcattttttctatagtgtcggaattcttggctaatgaaactttaaaatcttcttcagcaatacctattgatttgactagacttagtatagattcatcgttaaattgctgcttatggtttagtgcagcatggtagaactcgatgtatttacttgggtttattagatgtactgctagtgctgcttgaacagctttcagtgatgcttctccaagtattggaaaatctctaaatatgacacgtactttaccatcttgtattatttgtttcatatcttcagacatcattttgcaataaccacaagagtaatcaaagaattctacaaatacgattttactgtctttatttcctgcagaaggatatgagctatcctcaagttcagatttatacttttttatgtttttactcatttcttcattttctgcttgtgcttgccctctagttaggaggtcaatgactttttgagggtaattagcaatatattcttctacgattgagataattgtatctttatctattatagttttaccagatttgctagataaccaattgtttattaacggaaagcttgctactagtataactaaacttaataaaaataaaatccttagcattattaaccctaaaaatcatagaatgctaaagctactataaatttttgatgaagtcaataggagaaatagctgaaaatatagtgtaaatcataaaatatttaatgagtttttcaatgtttgtcagttgtaatataagtaaactatacatcggtaaattgggttcttttatcgtcaaatgttcagatagtgtcaggtaatttttaaagtcgtgaaaattacgtcataatgctataaatttttgtgtaaatttacataattctataaggaagagtctcatttttgtttataatgttgaagatatattcataggtttatgatgaaaattgctagtgataatagagaagtatgtgttggtgtgaaaatttggttatgtatatgttgtatagggatattgcttatggtgttagttggagggataacacgtcttactcattctggtttgtcgattactgaatggaatcctgttattggagtatttcctccaattggagaaagagcatggattagagaaaaaataaagtacatggctactccagaatttaaatatctaaattttaatattacacttcggggatttaggaagttatatttgatagagtattttcatcgattacttgggagaattgttggactaacatttttaattccgtttttatattttacatataaaaaaaaactacatagaaatttgataataaatttcatagttatttgtttgttaatactgtttcagggagttgtaggatggtttatggtaaaaagcggcttaattgatcgtcctcatgtaagtcactataaattaacagctcatttattgttagcattgttgattttctatcttttgtggagacaatttttattatctactatttctaaagtaacttataacattaaagtcaatggaacattaattttttctgtaattagtgtattaattgttactcaaataacatttggttcattagttgctggattaaatgctggattgttggataaaactattccttttttagcaggaaaattaatgttagaagatttgttattcataaagccattgtggtataatatttttgagaatcctgttacggtacaatttatacatgagctaatagcaactcttattttcttagtagttattataactttgttaatattaagattgaatctttttccagcatatttactattaatatgtttgtgtcttcaattaacattaggagtactaacatttatatataatgttcctatagttcttgcttctttacatcaagtaacagcttttattttatttgctgttaatacttacttgttacattatatgaaattatctaagttacaatatgttaaataggaggtttgtgtgcttgatagatgatacaaggaatgcttgtaatttcatatctttgaattaagtaagttgttatatatgttataagttagttttgtactttttgttgtacagatagctctgaagttttttagagtaatgatgaagtattgagtaaataataggcttcctgttgggtaaggcataaatatatgttgtgagttctaagattaaaaattgttatgtgtttttgactatttttatggtatttctagtgtgttatttagtcactgattgatatataatttaaattatttaatatagctttgagggtatagtttggtgttttaagttacaatcagtatagatagagatcatgctgtaaactattagattgctgatttttaaaagcttcaaggttgataacttgacattctccatatgtttttacttcgctgtggtcagatataattactatactatctttttgttttaatcttgtaaaaatgagttctaatattaattcttttgtattaatgtcaaggtgagcaaagggctcatctataatccatatgttggtgttatatattaataatctggatagtgcgactcttcttttccacccagatgataaatccttgtattttatgtctagtattggttgtaatttaaaaaagcatattgtagctgctattaactcatgggtattttttaagttagcccatagttggatattttctaggacagtgaaattgtcattgcaaaagtttttgtgccctatataagtaagagatgtaaaatatgtattggaatcgtggatgttttttccattatattttatgtttccatgtgttatggggactagtcctgcaaatagtctaagtaagcttgttttgccgcttccattattccctataactaatgttagtaagttttgttgtgtactaaaattaagctgggagaatagatatctattatttctaatgcaagcaaggtcagtacattctagcatgtttttacgtaagtgttacttaaaagttacacttatacttccaacaataaatttttgcaagtagattaattatatcataacactaaatattatatgtttatggccattttataaaacattagaagtaggttgctatatactatgataaaaggcttagatatatagattagagttctaatctatatcctggtacataattcctaactgttgtttactattggtaaagttacgtctaattggttcatatattttccctgcatttcattgtaggataagttgcactggctatctccttttaagaaaataaactggcacgctccttcaaaagcatagatttttgctggaagaggtgtggtatttgaaaattctaaggttacatatccttcccatccaggttctaggggtgttacatttacaacaattccgcatcttgcataagttgatttaccaacgcacattacaagtatgtcctttggtattttgaaatactcaacagtttttgccaatacaaaactgtttggtggaatgatgcatacatcttcttccttgtctatgaaacttcctagtgggaaattcttagggtcaactgttactgaattaacatttgtgaataccttaaatttattatctattcttgcatcatatccatatgatgataacccatatgataaaattccgctactcctcttataatcgataaatgggtcaatcattttctctttaatagccttatctttgatccaatgatctggcatgactgacatgtttagttcctcgtatagcacttgttaaatggtgaataaaacatttacaattaatcattgattaatgcaagttaaaattacttatgtatattataatagtgtgtatgtagtcgaagatgatttttaataataatttgaatgttatataataatactcaatgctagaaagtcagaatatattgaatattaatattgcaagatactatgcatataggtaaacaattcactgtgtttattgattatggttgttattattttaacagttttgtgtaagatcattaacctgtaatttttggcgtgcttatttgtataagcatggtaatttggtttttcaataatttttttctgtggatagttatagattacaattctttagctatgttgggtattacaacagtgtttcgatttttatcaagctttgtaacccttgtatgtaactaggatattgtaatgatatgtttaattcattttttatttttaaattgcttaccagttttctttcagaataaaatcttttcatgttgtctgataaatcttcaaagtccattggttctggtgtattaatatttaatagtgcagctccatacttaactacgtttgagtatggtgatggtaaatcatctgtgcagttgtatatgctgccggggttaggattatgtattgatgtaaataaaatatttgctatatcatcaacatgtatgcgagaaaatatagtatcactaatagtatatttaacgttaccttgtattaaattgcgtaatacgttcctagttggaccatatatacctgagagtctaaagatatgtgagggaaggttagaattatgccacattttttcctgctttagacgattaataccgttaggagttgatgggtttgttgaagatgtttcatcaacccaattgccattatggtcaccatatacatttgttgctgataaatatcctaaccatttgatttcttttaaaaaattgtagtatttttggagaatattgtctccatctggtgggattgatattagtacatgtgtcacatcagagaatacagattctggtaatggaaaattgtaatctaataaatgaacatctttattatctgtatgtgctactttgttaaataatgtaccgctaattttccattttaggggcagaagtttttgtgcgaggaatctagctgtatatccatatccaaaacaaaataaatgcataatttaaactgagtacaaagtatgtgcttatatacttggttttaacaaaaatcaatcgaattattatatattatttaacgttaatatataacttcatctggctagtaataaaaactgtataatatatatttgatctagtgcaaaaattaatatttttcttgcaaaaaatatattaacctctaaccttgatctaacatggtattgtatgttttagtacatgttattattaactagtatgttcttagcagtatagtctatgcgtttattttaatttttaaggatttttgaatgtctcaacggttagtggatgattcaacttacactggatatgtgaagtggtttagttcagaaaagggttatggttttatttgtaaagatcaaggtaataataagataaggaatattggtcaagatattaaggatatttttgttcatattactgcattgcaaagaagcaaaattgatggtttaagagaaggccaaaaggtaaagtatcagcttgataaaaataatggtaagttttcagcagttaatcttgagttgttagaaggttagaatcatgtaatgcgctataaatatttttattatattagaaaagtttatagcgttctttttataatattttagatgtaggttcttttagattattatcggttatgtaagcataagggctgatcttttacatttgttatgaataatttcttcagcatgtgatatcctaatgaaaggctggtttataaaggtatacagtaatataagtagatttcagttttttaaaatcgttgcttcgttcttagcaatatctgttttcttgtttttgattataacatactgtgttgtttttcatcatgatgatccccttgggcctgatcatagtagggctataaagttagtattctttgatttgatattatttctactgttgattgctagtgtatctcataagttgattaatatgtggatacgaagaaaaaggggacatttaggttctcatttgcaaacaaagattattctaatgttttcagtagtagctgttattccaacaattgtgatttcaggtttttctactttgttttttaattatagtattcaagcttggtttaataaaagggttgaagctgtaatgcatgagtctatccaagtggcagaggcttatttaagggagcataagagaaatattcgttctgatattttagctatttcacattatatatctgatcacaagataatattaaattatgatacagcagcattgcaaaatgttgtgcaatctagggcagatttattaggattggctgaaataataatttttgaaccaagtaggatagtagcaagtaataagtttagttttgtattaaattttgatatggtcccatggaatgacttagatagagtggataatgataggattgttattataataaaagaaaatatgatacgtgcttttcttttacttgatagattctcatctacttatatcatggtaagtcgtattatagatagaaaagttatttctcatttatcagcaacgaaaggagcagttaaatcatatagagatctgcaatcacagatatcatcactacaaatacagttttctatgatatttattttaatatcgttattgttattattgactgctatttggtacggaattaatttttctggtgacatagttcgtccactgttggatttattctacgctacacgtaaagttcaaaagggtgatttatctttcaagatagaagaaggacgagttggagaagaaatgtctacgcttgcacgtgcattcaatcaaatgacgtcacagcttagtagccaacgttcacaattgataaaactttatcaagatatgaatgaacgaagagaatttatagaagctgttttgtcaggtgtttcttctggaataatagcagtaaactgtgctggtataattactttaatgaatgataaagcaaaggaattattagctcctaatgatatcctacatgcagaacttgatgatgtatttcctgaaatatctgaattgattaaaagctctaaaatgcatgatgaaattactgttttgagaaatagaaagtctttcactttatctgtgagaataaaattgcttggtagtgttaataaaggatatattattacatttgatgatatttcaagtttagttgatgcacagagatcagctgcatggtctgatgttgcaagaagaatagctcatgaaataaaaaatcctattactccaatatatcttgctgctgaaagattaagtagcaagtatcagcatgaaattatttctgataaggaaagttttggaagatatattgatacaataattcgccatgtgacgagtattaggtgtattgttgatgagtttgcaaaatttgcgaaaatgtcggatcctgtgttaattaaacatgatatttgtagtgtagtaaaagagttggcgttttccgggcagtttagtcgtggtgttgtgcattatgagttagatataccaagttatccaatttttgttgtattagataaaaatcagataaatcatgtatttattaacttgttcaagaatgcatgtgaatcaattgatatgaagtctaatagtatacagggactgataaaaattagtgtagttgatgatagagattgtgttaatgtgcaaattcaggataatggtgtaggatttccagaagaacttatggaaaagcttacagaaccttatgttacaactcgtgtccaaggaacaggattaggtttatccatagtaaaaaagatactagatgaacataatgcaacaataagtttctataatatagaagatggtggtctggttaagttgacatttgtaaaatgtcaggattgtgaaaatatttaatgtaaatttataatatcctattattagcagttttgtttatcattaaagatacgattaatattaatttgctcaggtcaattttagatagttttcaagagaaataatggtctaatataaattgataatatgcgtgaaaatgttagtattttattggttatttttaatagatataaaaagattttatattaagtatttttgcactgaaattataaaggtttaaattgtgaagaagaaaataagtatatgttaattgatactgtcaaagaattagagcgtttgtgtaatcagctgcttgtattgcaacctaaatttattgcagttgatactgaatttgtaagaagtagtagtgaatattatcctaaattatgtttaattcaaattgcatatggtaaagaacagtttgttattgatgttttagcgaaagatatggatttatcagttttaggacatattttttataatgaaagtataataaaagtttttcatgattgtagacaagatatagatgcattgttaacaaaatttccagaaattcctagccctatatttgatactcaaattgctgccatgttttgttgttgttatgataatgcagttggatattctaagttagtagagcaatttttaggtatttcattagataagctgagcttgaaaagatctaattgggcgcttcgaccattatctgctgataaaatccagtatgcacttaacgatgttatatatttgtatgagctttatcaaatattatataacaatttattagatgctggaaagttaccttggtttttggaagagatgaataatatagtgttacaggaagttaactgtaatgatgtttgtgatattcctgattttggttctgatatgacaaaagaggagattattgttgtaagatctgtaattgaatggcgagaaagattagcaaagttttttaatcttaatcgcgaatttatattaaaaaacaaggtaatgctatctttagttagagattttataaaaaaaagtgatattagtactttaggtaagtatataaagaaagaatatttatcatgtgatgcagtgtctgatcttttacaagttattgataataatcaatctgttaatattgatgagttacattatgtaagtgttaatagttataataagtctgttttaaatgtgctgcttatattgttatataatatgtgttacaaaaataatatctcacagaagttagttgcatctaaaggtggcctaattaggtttcttaacggtaagtttagttatgtaatgaaaggttggagatatgaattttttggatgcgaagttgagaaatttatgcaaggaaaatctaagattatagtctcagcacaagtactggataatgattgtatggatattgtaactactttgacggaaatgtagacttgttgtaaagtaagaactctgatagatattataggatactgtaattactggagaaacgtatgttagtgcagtaatagcataaaaaaatgtatgtgtttctagttacagagtagttgaaagtttattgtgtgtcatggtgaaaaatccacattatcttgtataatctcatgtaatgtaaaatttactgttttacgtgttgaaaagggataatatattgtaaaataagtatttgtgttgcggtcaaatatattataaagactttgtgagattgcttattattaaaaattgtgtgtttgagtgaaattcaattttcacttgattgggtatattgtaaccataaatcttcagttaaaatctgtacattgagagattgtgcttttttatattttgatcctggattgtttcctgcaattaggaaatctgtattttttgataatgatgaagaaacttttgctcctgcagtttctgaccttatttttgcttcagatcttgacatacttgataattctccagtaaaaactatgatctttccatgaatgagtgatagataagagctagactgtgtatctgttattgttaggtgttttactaaatcattaatcatatttaaattatgtggttgactaaaaaacattttgagtgaaccaatagttttggaccctatctgttgtatgtttagcgagtaatcttcattctgtgctaacttgagcatctcattataccatgtttcatatgatgaaaaatggttagctagtatttttgctatgtactttcctatgaatcttattcctaacgcaaaaataaaattttccaagctgattactttactgttatttatagcagaaaataggttactcatggatttttcaccccacccatgtaatgactctaattttacgtcactattacttattttttcttctaatgtgaatatgtcggtaatatttgttattaatctttgttcatagaaaaataagagctgttttttcccaaatccaataatgttaaaagcgtcttttgaaacaaaatgctttattttttccaggatttgatctttacaaaataattcaccagtacagtatattgatgcttcttgctttgcttgatatacactactaccacatgatggacatgttgttgggaaaacgaattttgttagttcttgagttcttaaatttttatctacatccacgatttgaggtattacatctcctgctctttttacaataacatagtcgccttcacgtatatctttacgctctatttcatttttgttgtgtaaacttgctcttgtaactatgaccccaccaatatttataggagaaagttctgcaatgggtgtaagtacaccagtcctgccaatttgtatggaaattttatttaattgggtttttgcttctgcagcaggaaacttatatgctatagcccatcttggtgatttacttgttgttcctaagatatgttgtgatttgatatcgttaactttgtatattataccatcaatatcatagttgatattacttctattgttataaacttgattgtaaaaattaaaagcctcttcaatattatctgtagtaatagtatgttcatttacacaaaagccccagatttttaattggtataataattcttcttgtgttagacatgcagtgttgactattgtatacataaaatattttagtttacgttgggcagtaatgttatgatctagttgtcttacagatccggctgcggcgttgcgtggatttgcaaaattattcccatcattattaagttgtataaaatcacagcgatctatatatatttctcccctgacttctagaagatctggtgcattgtgaataatatgtggtagattttttatagttttgacattggttgtaatattttcaccaaaatatccattacctcttgtggatgcttgatagatttctccttttttatatatgacggaaaatgatagtccatcaatttttaattcgcaagataatggtattgattgattgtcattgatgtttaagaactttttagttcttgtgatgaatttctctacatcttgttgattaaaagcgttatctaaggaaaacattttctcttcatgtttaaccttagcaaactttgtgtctggagaactacctatattgttttggtaatcgttactttgtgtgagttttggaaaggcgttaagaattaaatttcttttgcgacataactcatcatattcagcatcactgatttctggattgtcctgtacataataaagaacatcatggtgctgtatttgcttatttaatttatctaactctaatttagctttttcctggtcgaccataattagtataaataaacaattttgtgctattgagctacaattaaattatttttactaagtaattcttgtagttctccattgtgatacatttccttaactatatcacacccaccaataaattcacctttaacgtatagctgtggaatagtaggccagtttgtaaattcttttatagcttcacgtaattctaagctttctaatacattaatgctcttgaatttaacattcattttttttaagatactaactactacactagaaaatccacattgtggaaaatcagcatcacctttcatgtataaaactacatcattattttctatatcatgttttattttatccattatatcatttgtcatagttattacttacatcctgtttgtatttgtattgcatgtatgtttaatccgtctagtactttatatatcattctatgttgttccaattttgactttccttgaaactgacttgaaattactttaatcgagtagtgattattatcacctacaaggctagtaacagttatttcagcttctggaaaagcattccttattagaagctccaactgagattgcgtaacagtcattatttaacaagatcatagattgatataaaactttttactataacatgttttagtgtagaggtaaatagttttaaagcaaagctattgtatgtaatatatgatggtcctatgacttttatagttgttgagagctatgcttattgttaatttgtgaaagtacatattatgtttgggtattaagatattattatttatgagtaatatcataaatacattgagcatagcattattgtataatctttagtatttgattttcccatgtatctctagatacactaccgtgtatgtgtagtaatattttgccatttttatcaaatataaaagtttcaggtactcctgttactcctagtacatttccagttttacctgaataatcttttgctattttggtatatggatctccatgtttttttagccattcttgtactttatattcagtatcaaggtaatttattccgtatatttttattgtttttttctcagcaatttctaaccataaactgtgttcttcttggcatgtcgtgcaccaagaggcgaatacattgagtatgtatggttgtccaattaagtcgtttgtatcaaatacttgatcttctgtaaaaagtataggtagtactactctgtttgtagtatcagtgatagtattttggtttaataaaacttttgtgagtatcacggtaaaggttaagaaacatactagtaaagctgtagcaattattctcatagttcaataagatatttttttaatgtttttatatgacctatttctacgatattgatatcggaaaagatatgtttattattaagtggaataatagcttttgtaaagcctagtttgtgggcttcctttaagcgtgcatcaatatttgatatatttcttacttctcctgacagggcaatttctcctaatattattgttaaagatggaatagctatgttaataaaacttgatattaaggatgctgcaatggctaaatctgcagctggttcacatatttttaatccaccagcaatgttaagatatacttctttatctcctagaaatatgttacattttgcacttaatacagcaatgatcattgctagcctattaacatcccacccaactactgctcttcttggggtgaccatatttgtatttgcaattagtgactgtatttccattaatataggtcttgagccttcaatgccagcaaaaactgcactaccaactatattgttgttctgtgacctagctagaaaaagagatgaaggattttttataggtattagtcctttatcagacatctcaaatacacctatttcattagtaggtccaaatctattttttactgtgcgtaaaatacgtaattgattattattttctccttcaaaatataatactgtatctaccatatgctctaatgtttttggtccagctatttgaccatcttttgttatttgtccgagtatgaatagtattatattgtgttgctttgtgaatgtgattaattcgtgagtacacatacgtatctgtactactgttccaggtgatgatgatatcctagtatcatatatagtttgtattgaatcaataacaacgcatttaaaatctttgttttttttaagggaaaagataatatctgataatgatgaagtagataataattgaatgttggactgggtgatttgtaatcgatctgctctaattttgatctgatctatggattcttcacctgatacataaagacatgtggaaaaatgtttatctaagattgccgttaattgtaataaaagtgttgattttcctacaccaggttctcctcctacaagggtgctactccctaatactataccacctccaaatactctatctaattcacttattttagtaataaagcgtgatggagctagtgtatttttgtcagataatgaactcagttttacttcagaactatgttgtgtattgattaaatgttctgtgcctgtttcctcaataatactatcccagttaccacatgcattgcatttaccagtccacctatgtgtttgatttccgcaaacttggcagacatagaaggtttttgtagacatacctatagattataaagttgtgttgtccttgacattgatcttaacaaataaaaagtatattcgctactgtaagttttttttatatgattttatgcttttggttaggatatataggaagagtagatatttcattattaggttaaattatcttattgtattaacagtttgtggacagtgtttttgatgtacatcaacaaaagtataattttaattaatacctgtgaaatattaaaatagcacttatatagtatacattaaagcaatttccaaaatagttaagtaaatatcaatgcatgaggaaaaaacaaagatttttactaaaactgtagcataatttattaaatggttttaatttagattaattgagatatacatatactttttttgtattaagtatattttaggaaaatgcggatattacttagaggtcatattttattgacgtgaaaagtatgtagtgttattaactgataaagtgtcatgaagggaattaattatataatgaaaaaggaagcacaacatatacaaaatttaatagatagagagttggattcctctaaaccaattgatgaaggtcataaaattactggttatacagtgagttttatagcgtttttatgggcttgttttcaattatttatagcatctccattacctttttggttagtaaattgtgggttggagtgggcagtacttcctgatattaaatctcgggctattcatttagcatttgccttttccttattatttttgtttttgccaatatctaagaattctaatcgaggatttagagcattagattggatttcttcaatattatcatgtgtaacggtattatatattgttgcgttttatgaagatctatcatttaggattgcaatgcctaatgatattgatttgattgtagcattttttggacttttgtttctattagaaggagcaaggagagcgataggaattcctatatctattattgctatagcatttttagtgtatgcttatctaggaaaatatatgccagatattattgcacataaaggacataatttttctgctatagcatctcatgagtggttatcttctgaaggagtatttggtgtagcacttgctgtgtcatctaactttgtatttttatatgttttgtttggcgcttttctggataaagcaggagctggaaatttttttattaaactttcttttgctttacttggtagatttgttggtggtccagctaaggctgcagttattgcctctggttttatgggtatgatgtctggctcttcagttgctaataccattactataggttcttttacaattcctttaatgaaaaaaatgggtcttagtcctgaaaaggcagctgcgatagaagtatcagctggtgttaatggacaaattatgcctccagttatgggtgcagcagcatttttaatgtctgaattcttatctattccttatgctactattgtaaagtatgcttttgttcctgcagttatggtatatgttactttgctttatattgtacacttagaagcatgtaagttagatatgcgtcctgtacttgacctaactaaagcaagatctatttatttaagtgttttaagatttcttatagctattgcctgtttggttgttttttcgtgtatcgtttatgtactaatagaagggattagtatatatggattctatgtacctggtattaaagcaatatttttagataaaagtatatattgtatatcattggttatagtgtctgtgtatgttgccatattattttatcagttcaagggtaagagaagtaatattgaaggtgttgaagaggaaaagaaatatccaaaattatcagaaacttttaagtatggtattcattattttattccaatttttattttaatatggtgcttaattgttgagaaattatcttctgctttagcttgtttttggacgaatttatttttgatatttatcttgcttactagagatgtaatatatactttgtttaataagcaattatcaagcttatgttctgtattttgtggaagtgttaagcaagtatatgaagctatggtcatggcttctaaaaatatgatcgctattgcagtggcaactagtgcagcagggataatagtaggagcggtatcattaactggatttggtttatcaattagtggcttacttgattctatagctcatggtagtttgttccttactttgttagtgacagcagtaatatgtatagtattaggtatgggcatgcctgcaacaggatgctatattatagtatctacgcttatggctccaattttaacttctgttatacataagactggtttgtatgttcctcagatagctattcatttatttgtgttttatttcggaattatggcagatgtaactcctcccgtagggatagcttcttatgctgcagctgctattgcgaaaggtaatgcatttaaaacaggagtacaatctttcttgtacaatataagaacaatgattgttccttttttgtttatatttaataatgagctcattttatatgatattacaaatatctggaataatatatttgtaatttttgtctctttggttggtatattaagtatttctgcagcaatgcaagggtactttattaggaaaaataagttatacgagtctattatgcttttaatgttggggataatactgattatgcctaattatattgctaaattatttgtatctccttatgatactgtaccattttctaaattaaatgataccttagtagtttttaaagatagttctgtgagacttactgtagaagcgagtaatcaacctgataaagtaaggaaagaagtaattattccattaaaagataagatagaagattctgaatatcgcggtacattatttgatttattaagccgaaatgttggtattactgttgatctcaataacacgtctgatggctatctaagagttaaagagatagcaagttggagttatatagaaccatctgatatggatgatagttattccattgtagaattagcattatcgttaaaaaagcattatcatgttacttatgtttacttgatagctgttatattactaactacagtgatctttttacaaactagaaagagtaattttataagacaggaataggtttatgctagatatagcagtaattgggattatattattgtcagttgtaattggtctttttaggggttttattaaggaaatatttggattatgtggtatctgtgtatcaatattgttgactatgcgatatcgaagttatttttctggcttgtatggtcaatatgttgtttctgacattatatcggagattttatctacaattactgtttttattttgatcactgttgctattattgttgttaatgggtggattatgcaccttttatcttcagcaagatgtactgtgattgatagatttggtggattgttaatagggttcataaaaggagtagttttttcttattttctattttttatcatagaaacctcttgttatgcattattacctgctgcagagaaagaagatgatgaagtattgcctacttggtttgtgaattcatattattataatatattttatatctttaatacttatgtagatgaaataatgccagaatctactcatgagaagattcaagaagtagaatctgcagtgcaggatattcttgagaaaaaatatactgctagtaatgtaaaaaagaagaactacaaacgtgtagaaagggatatgactaagaaaatataagcttattagctgatagcattatctagtgtatgtcaaataataaaaacatttgattagaaaaataattaacttgattataatgtaatattttatataatggcgtagttagtttttgttaaggagaagacgtgcctttatatgaatttacttttatagcacaacaaggtttgactcagtatgagttagaagggttggttaaagggttatcgtccttgttaacaaaaaatggtgctgagcttcttaagtatgagtattgggggcttttagattttgcttataccatagataagatgaataaagggcattattgcatgatatatataaaagcaactcctagcagcatggatgagtttaagcgtaaagtcaggttaaatgaagatattttacgttttctgtgtcttaagaaagataagttaccaaaaggtgattctttgatgatacaagcaagtcaagtatagttggatatttattatgttgaaaaaaaataagaaagcaaattctaataattcgggagcgactgcttattctccattagcttatctcaaaagaccgtactttaagaggtctaaggcttgtccgttagaacaatgtcctaatgaagatatagattataaaaataaaggtctgctatctaaatttacctcagaatatgggcgcatattacctagtaggattacttctgtttcatctaggaaacaaaggttattgtctactgctgtaaaaagagctcgttacttagctttattgccttattgttgatattttttataggttaatatgttatcagttattctaaaagaaagtgttagaaatcttggtaaagcagggatggttcttaaagttaagccagggtatgctaggtacttgctgacacagaaaaaagcagttagagcaactaaggagaatttaaaaagcttagaggagcagtacttatttattgaaaaagaaaatttagaaaagttagaggcagctaaggttttaaaagcatccttagaagatgagttcttaattataactaggcaagcagctgatgatgggaaactttttggttctgtaaccccaaagtgtatatctaagttgttatctgataaggggtataatatacattaccgtaatatatttttttactctgtaattaaatacattggtgaatatgtagttaatttagaattacatcctgatttagttcttcctattacactttatgtagttaagaatgatttaggagctatgcaagcacaaaagttgcatgcagaaaagaaaagaaagatagaagaagggaaagttgaaaaaggaagttgtactgagggtgaaagtttagaacttggtagcgttgataatgatataaatagcggtaatgtagacagtaatgagagtgagaaacaggatagcgtttctgaataacactttaagttgtatctaattgtaatagcgctgttaagagttttttataatttattacggggttctttctatggttgggtatatcttagatgatgatttacaggaagttgatgctgaggtttttaattgtatttctggagagttaaatcgacaaaattctggactacagttaatagcgtcagaaaattttgtgagtaaggcagtattgcaagctcagggttctatatttacaaataagtatgctgaaggttatccaggaaaaagatattattgtggatgtcattttgcagatattgtagaaaatttggcaatagaacgtttatgtcgattgtttggatgtaaatttgcaaatgttcaaccgcattctggttcacaagctaatcaaggagtatttgctgcattgttaaagccaggtgacactgtcattggtatgtcacttgattgtggtggtcatttaactcatggttctgctcctagtatttctggaaagtggtttaatgctgtgcagtatcaagttgatcgtgatactggtttaatagatatggatgaaatagagaagttagctgttgaacataatccatcattaattattgctggttcatcttcttatcctcgtgtaatagattttaaaaggtttagggaaatagctgataaagtgggagcatatcttctagctgatatagcgcattatgctgggttaattgctgctggagaatttccttcgcctgttgaatatgctcatgttattacgtctactactcacaagacattgcgtggccctaggggagcagtgataatgactaattatgaagatatccataagaaaattcaatcttctatttttcctggtatgcagggtggtccgttaatgcatgttattgctgctaaagctgtagcatttgcagaagcattgaaacctgagtttaaagattatgcgaaacaaataataaaaaattctaaggctttgggtgaagtatttaaagaaagagggcttgatcttgtgacaggtggtacagattctcatatggttgttcttgatttacgttcaaaaagtgttacaggtaaagatgcagttcttgctttagaaaaactaggaattatttgtaataaaaatgctattccttttgatccagaaaagccttttgtaacttctggtttacgttttggtagtgctgctgagacttccagagggttacaagaatcagaatttagggaaattggcagtatggtttgtgatgttattgatagtttaaaagctagtgatagtgttagattatctgttgaaagagatataataaaaagagttaaggaattaacttctaattttatttagttaagtcaatgtaaaatgatatttaaaaatgtaaataatttagtttttatttacatacttttttaaatgtgattaacatataattagctatatttttgatttgctagaaaggttcatgttatataagtaacgttgctataagctgaatggtagggggcatgtcgcattctttatgtatatctgattttcaaaatttatcttgtaatctcttaaatactttaactgcaatggtagataaagtagatgttgatggagtgttggagtgtgaaaattatgacggattagtaaaaatatccgatagtaaaggtaatgtgtatgttattaacaaacatgatccttctatgcaaatttggattgcttcacctattagtggatcagtaagatttaattatgatagatgctcgggtacgtggataagtaataaaaatgatgagttgtttgatttgtttaaatctgaaatgaaagtattgtttaatattgtgatataaaaatgaaagtgttatttcaatttgtaagacctcatttattatactttatatttgcgtatttagttgtagctgtttcttctatatcaattttagcatttttttatgagttacgtaatttagtagacttgtgtattgcaacttctgatgttgcagccataaataatgccttgttgtttttgtttagtatagttttaatagtagggttatcatcctttttgcggttatggcttactggttatgtgagtgagaaagttattcttgatattagaataaaattgtataataaaattatacatttttctcccaggttttttgaaaataatagtatatcaagtttaattacacgattaatggcagatacagcaacactgcaagttattttaagtactagtatgtcgacaatacttaggaatacaacaactttgcttggtagtgttgtgatgttagtacataccaatgttaagttgactatgtatactgtgataattactcctattattctgataatcttagctttcttcggtaaaaaagtgaaggtattattacgtaaggtacgcgtaaatctggataatgtaacttcttttgttgaggaaacatgtcgtggaatatatgttatccaatctttttcgagagaagatataacaaagcaaaagttttcaaatttgcttgctaatacactaagtatgacaaatagatatattgttttacgtgcattactagttacattagttataacgcttacaatgctttctataggatttgtcctatcttttggaataagagaagtattgaatggtaatatgactgttggttctcttttttcttttatattttatgcaataatagctgctagttcaatgaataatatgggagataattttaatgatatacagaaagctgtgaaaatttcagaagatatttctaaaatgttgttgatgcagacagatattattgaagtaaaagatccatataaaattcaggaagtacaagataaaatttcaataaacaatgtcactttttattaccctagtaaacctgataatcctgcattaaaaaatgtatcatttactattgagaaaggtcaagttgttgctttggttggaccatctggtagtggtaagagtacaatagtgaatatattgttacgtttttatgatgtgaatataggtaatattactattgatggtatggatataaagaaattatccttaatgaatttacgttctctatttagcattattcctcaaagtcatataatgttttccggaacaatatgggataatataacttatggggtaactaatgctgaatacgaagatgtaagaaatgcagcaaaaatagcttgtattcttgattttgtagaaagtttaccagataaatttgattctttagttggagaaagggggttgtgtttatctgaaggacaaaaacaaagaattgctatagcaagagctgttttaaaggattcaggtgtccttgtattagatgaagcaacatcatctttggattcgaaaaatgaacaactcatacatgatgctttagataatttaaggaataatagaacaatacttgttatagcccataggttgtcaactattcttaaggcagataagataattgtttttaataatggatgtattgatgatataggtactcataagtcattaatgcagaagccaaatggtttgtatgcgaaattagcaaaattgcagttatcaaatgatagtttttcagaggatatttaattagtaaagatgacttctgttggggggtgatattctaaaaccttctgatgaataaggctgttatggtttgtagaaattatattttaatttactatgcttagacttataaagtttgtttttagtggtgtatatgtgctattggtattgtaatctagtggatgcatttagaatgagtagtatgaaaaaaagtatattttttcattagttttctgtgctataaatttgtaggagttgtttttgttaaaatggtaggaattgtttttacaaagtttatatgtagttaatttatagatatattttcaaaatgtttgtaaaaaaggaagcatagaagtgaaagaaatatactctattgctttacctgagggtagatatattttaatcttaggtgtaagaatgcttttgcaagataaaagttggattattattgctggatagtattagctttattttatatatgaaatataaggtctaaaagtaatagtattgtaaactggagtgaaatctatagatgtctgtaaaatatgtataagaatttttatacgatgaaggaactacttattaagacatttttagcttcatagatgatgttttttggagaatgttatctgtccataattgttaggtgtagtggcaataggtacagtgcgactagcaatttacaattattaattttctagattttgtaaagattttagtcattttttactaacaaatgttaatactgtctgtaattagttttttaataagattgcaagttatattgtgaagttatttaacataggaattatattgactcattgtgttattgtggtagcctaattatatttattatttaagtattatttattgtaatgtctggttctgcatatgatattataaatcatgaatatgatgttgtaatagtaggagctggaggagcaggtttaagagcaacttttggtatgactaatgttggtttatcagttgcatgtatatctaaagtttttcctacacgaagtcatacagtagcagctcaaggtggtattagtgctgcgttaggtaatgtttctgaagatgactggagatggcatatgtttgatacggtcaaaggttcagattggcttggagaccaagatgctattgaatatatgtgtaaaaatgcggcagaagctgtaattgagcttgaacgttatggagttcctttttctcgtactagtgatggtaaaatatatcagcgtccttttggtggtatgactacagagtttggtaaaggtaagccagcagtacgtacgtgtgctgcatctgataaaacaggtcatgcaatacttcacacattgtatcagcaatctttaaagtataatgctaagttttttgtagagtattttgctattgatttaataatggatgaagaaggccagtgtaagggtgtattagcatggtctttgtgtgatggtacgttacatagatttcgtgctcatattgttgttcttgctacaggtggttatggaaggatatatttttctgctactagtgcacacacttgtactggtgatgggggaggtatggtatcccgtattaatttgccgctggaagatatggaatttgtacaatttcacccgactggaatatatggtgctggatgtttgataacagaaggttgcagaggggaaggtggatatttaattaattctgagggagaaagatttatggagcgctatgctccaaaagctaaagatttggcatctcgtgatgttgttagtagagcaatgactttagagattagagaaggtcgtggtgttggtccaaaaaaagatcatgtatatttgtctatatctcatttaggtgcaaaagttatcagtgaaagattgccaggtattcgtgagactgcacgtacttttgctggagtagatgttataaaggagccaataccagttttaccaactgttcattacaatatggggggtatccctacaaattatcatggtgaagttgtaactttaagcaataatacagagcagataatacctgggctttttgctataggagaagcagcgtgtgtatctgtacatggtgctaaccgtttagggtctaattcattgcttgatttagtagtttttggaagagctgcagcaattagagcaaaagagttaatcaaacccggaatgttacatgctccagtgcagaagtcatcagaagagtggataattgataggtttgatgcgttaaggttttcaaaaggaagtttacgtgtatcagaaatacgtagtaacatgcaaaatgtaatgcaaaatcatgcagctgttttccgtacagaagaagtgcttgaagaaggcaagcaaaagataagaagtgttgctgagtctctgtctgaaattgcggttaaagatagaagtatgatatggaatagtgatttggttgaagcattagagttaactaatatgatgccgcaagcagtcgtaacaatggaatgtgctgcaaatcgtcaagaaagtagaggggctcatgcacgtgaagatttccctgatcgtgatgatgagaattggatgaaacatagcttagcatggtataattctacagattgttctgtacatataaagtataaagatgttgctaaagcaactttaacagatgatgttcagtattttcctccacaaaaaagagtatattaatactatctatatagttatatggtggttatttaaaaggtttgactatggttcaattttttttacctaagaattctaaagttaataagaacggtaaggttcatcatgctcgtaaaggggcaaaaaatgtaaaatgttttaaaatatatagatggtctccagatgatgatgaaaatccaaggattgatacattctttatagatcttgatgaatgtggacaaatggtgcttgatgctttaataaagatcaaaaatgaagttgattctacattaacattcagaagatcatgtagagaaggtatatgtggttcatgtgcgatgaacattgatggtactaacactttagcttgtacaaaagcaatatcagatattaaatcagatgtaaatatttatcctttaccacatatgcatgtgataaaagatttagtacctgatttaagtaatttttataaacaatatgaatcagttactccgtggatacaagctgaagaacctaatcataataaagaaaggttacaaacaatagaagatagaagcaagttagatggaatatatgactgtatattgtgtgcatgttgtagtactagttgtcctagttattggtggaattcagataaatatttagggccagcagctttattgcaagcttatagatggcttattgatagtagggatgaagcatcagatagtaggttagatgtacttgatgatgcatttaaattgtatcgttgtcatactattatgaactgtactaaaacttgtcctaaagggttaaatccggcaaaagcaattgcacatataaaacaaatgatggtaagaagataaatgccgttaaagttatatttcaatggttaatcaattcatagtgaaataaagttattggtatatgtggtttgcacaattgtatttttgacatgtattgtgagaagggaaagtgtaaaagtatatttgattctacattatgagtccatcaattcactgtattaatggaaatgtttttaggatttacagtacagttgagaggaattttattgagattgaaataatttttgctgttattcaagagattttgagttaatctatagtgtgaaatagtttgaaattttgtagtatgcttttttcccatgtgaatagttaatgagaattttaaaagcttgatctaatgtagacaattgctagtattgagtatgagtaattaaaatgtagggaattatggaatcagcagttacaaaacgtatagttgtccctgagttggaagaaatcctttataaggaatataaagttttagacaaaggatttgttaggttgattgattatatgggatctgatgaatctatagtgcaggctgctaggatatcttatggcaggggtactaagagtgtcagtcaagatgctgcattgattaattatttgatgcgacattcacatactactccatttgagatgtgtgaaattaagtttcatattaagttacctatatttgttgcaaggcagtgggtacgtcatcgtactgcaaatgtaaatgaatattctgcaaggtattctgtgttagatcatgaattctatattccggagcatagtcaagtggcaatgcagtctgaagataatgctcagggtagggggaataatttatctgatgaggatgcaaagtatgttgctgatcttttaacacgtgattctgatatggtatatgaaacttataataaatttttggagaaaggtgtttctagagagatagcacgtgttaaccttactttgaattattatactgaatggtattggaaaatagatttacataatttattacacttcttgaaattaaggtctgagatgaatgctcaatatgaaattagagtatatgcagaaactatgttggatattgtaaaaaaatgggttccattaacttatgcagcttttgttgagtattgtttaaaatcgcaaaacttttcaagaagtgcattagatgttgtaaagaagttaattgttggagaaaaagtagttcaagaagatactaatattggaaaaagagagtggagggaactgatggctattttaaagcctgaatgagtttttttggattagtatcagtaaattcttagttattatgtaaacgtctgttaaggtttaatactttatagttttcaagtacttgagatttttagtttataggcctgtatattaatttatagaatatatatgattagtattttttactgatcaggttttatatattttataaactcaggtattttttcataaatcatagttagaggtaaaatatattttcaaatgttggttttaaagatttagttctatttaattatctacgataattttatatgagatgttatattagcaatgtgtttattaattaaggattccattttagtgtatgaaaattttaaaaagaaatattttaattcttattattgccgttattgttttatctgatatatcttcagatatatatttacctggactaccgaaaattagtgattttttttctgtagattatgctatcgcacagctaacaattagcttgaatttagctggaatatctatttcagggttattatatggtccactgtctgattattatggacgtagacctattatgttgttaggtgtgggaatatttacattagcaagtgtagcatgttgttttgctagcaatattactgtgttaattattatgcgttttattcagggatttggtgcaggtgtagctggagttgttggctatgctattatcaaagatatgtactctggaagtgactgtgctaaaaatatttctatagtaaatatggcagtagcattttctccagtattgggaccgattttaggtagtgccattatagcacatggttatcattggaatatgctgtttatagcaatatcaataatggcaataatagttctaatatgtctatttgtgtttttgaaagagactattgttcttgagaaaattaatagtaatatctcttgcttgtcaattatgcggaagtataaagagcttgttttaaatattcgattttgtggttttgctttaattcaaagttttactattatgtggatttggtcatgtatagctaatttaccatttatttttgtaaaagatatgggtgtacctgttggttattatggctattttgtggctattaatgtagctgcatatattgttggtgcaatgctaaatcaaagatttgttgagagatttggaataaataatatgttacttttaggattaattttaactactttatcagatgtaagtgtcctaatactctatcaaatagttgaaattactcctttattggcagaaattatgtggcttccatctggtatgggtattgcttttattcttggaaataatatgactgctgcgttttctgaaattagggagccaggtataggttctgcttttattctgtttttgcaaacaatttttggtgcacttggtatttatattttaggatgtttttatgatggtactctgattccagtgatactatttccaataatttgttctacaatttgcattgtgatatatattcttttaaggaaagataaaaataataaatctgaattcattagtgcatgattattgtactgtttaacaataggaagtaaaattgtgattctaagtgttttttatttataaaataggaaaaaatggtagatttgtgtgaatatatgtttagcttattttatggttttaatagtaaaaagtaaggttgtatactaataaatatttagtttttttacacttaaaaaaggtttataaaagtaatgtttaattagtttgttcttaaatatattcttgttctctaagatgagagattgctttttctgtaattactctaccacgtggtgtacgttgtatgaaatttatttttatcagatatggttctatagtttcttctatattacctgtatcttctgataatccggaagatatagtatctatgccagttgggttgttagagtcgtatatgaatttgagatattgaatatcctgtctatctaatcctagtttatcaatacctaaacgtagtagtgctttatcagcaaatgtatctgtgatgattttgttatgttctgttacttccataaagtctcgtattctgcgtaataatctgagcgcaattctaggtgtaccacgagatcttaaagaaatttcttgtgctccactattagaaatatttgtcttaataacttttgcagcacgttgtattacttttgtaagttcttcagttgagtagaattctagatgtattggaatgccaaagcgatcacgtaatggatttgataataacccaattcgtgttgtcgctccaactaatgtaaatggcggtaaatctactcttaatgtgcgtgctccacatccttctcctactattatgtctagacaaaaatcttccattgcggaatataatatttcttctatattgcgatttaagcgatgtatttcatctataaataatatgtcttttgcctgaagattagtaagtattgcagctaaatctcctgctttacttagtaatggtccagctgttgatcgaaaatttacttttaattctttagctattatgtgtgctagtgttgtttttcctagtcctggtggtccatataataatacatgatccattggttctttgcgtgtataagctgcatttatgaaaattttaagattattaactacactgctttgtcctatgaaatcatctaataggttaggtctcattgagacattttgttggtcttctaaacattcggtactttgcaatatatttttcataaagtgctctttattatttttctatatgactttttctcttaaagtgtaagagtataatactctattatagataaatttgtactttataattaaaagagtaataactattatgtttttcatgctgtaaagacataggaaatcagtatcagcatatgcataatgcatgagtgtttaatacatttatatattaagaaatgtaatttttctaaataattatgatatctttatactttttgtatacagctaaagcatcaaaaatttctgggtttaatatgatgattattccacttgaaagtaagacattgaagtgatattaaacgatatttgctacttttattattgaatatggaaaaatactattatggatatatctttaaactaatggatagaaattagaatggtgtattgcttactgtatttaactctataatagctatagtaatcaagtcaggtaataattgatttatgttatagtaaagtgtttttttgatgtttctagcgtttttgtaatctgagatgattataaaaaaaaatcccagctatatttatatgtataggaatttttatatcgtttattttttgtgatttatgtctattgagaaagtttttgcaatgcttttcgtataatttcttgtatgctgtcatcaggaaaattggcttttatttcttgtattgcattgaaagcttttagtttgtcataccctaaacttataagagcagctaacgaatcatcttcttttattatgagggtttcttctattggcattttactaatcttatattgaagttcagttgtaatacgtcctgcaagtttttctcctataccatttcccctaaatgcgtttttgttgttacttactactgcagaaaagatttgttctggtgatagtttacttaatattgagatagctgttttatggttaataccatttattgtaactagcattctcatgtaatcttgttcttgtttatctaagaatccatacaactgagttagattatctctgtttacataggtttctatgtaaagtttaatgttatttccagttttgcaactttgtaatactttatgtgaaacgtaaattatatatccaacgtttcctacgtttaatatgatgtagttattgtatatttcttctataatacctgtaagactacctatcaacgttttcctcagaaaatattatttaacaagataagtttagaattgattctacgtaggttgattagtgtgtgtgatctaagtattaacaatatacagaatagcactccaagtgtagtaaacattgtaaaaagaggtattagcattgatatatcaatggtagttccatttgtacgtagtatacttgcaggctgatgtaatgttgtccatatatttacagaaaatttgattactggaatgttgattgcactgaatatagcaaatattgaagcagctttcatagatctggcttcattatcaaagaagttccataaggatatatatcctaaataaagaaaaagcaatactaacattgatgttagacgtgcatcccatacccaccatgttccccaagtacatttaccccatatgctaccagtaattaaacatatagatgtaaacgttagcccaagtggagcaatagcatgtgatataattgctgaaatcatatttcgccatattagtgctataaagctaaaaactgccattagtgtatatgagccaagtgaaatccatgctgctggtacgtgtagatacataatacgaacaagttctccttgcatataatctgcaggagatgaaatgaatatcatgtataaactgcatactaaaagaacaaagaataagaatactgtatatggtaaaaccgatcttgtgtaacggatgaacttactcataagtatatagtcattacatgatcatttaacgtaccataaattacagcattaggcaatctatatgatagaagtgagtcatgggatgtattgtataatataagttattggtatttttatattttagtatagttttttgtttgtaaggaatattaattggtaagaagagtttattatatatcaaatatatattgtgtttttgtgtactattatagtgcttatcagtaatatgtttttttattgtattgaaaaatttgctataggttttatataattgctgaagtcttacaaatgattttattttataaaattattgctacataagtgtggaaagtgacattgtttaatatttatataatggagttttattaagttgagttatatacaatattataattattattttttttaggaaatgtaaggtgaatgatagtttaaaaagtaggggaataatgttagttatatcatctccttctggaggtggtaaaactacaatatctcatttgttaattaatgaattacaaaatgatcttgttaggtcaatttctgttactactcgtgaacctagagatggtgaaatcaatggtaaagattatttttttgtaactgaacctgagtttatcaatttgtgtaatacaaatcagatgctagagtatgcaaaagtttttgggaattactatggtataccccgtaagtttgttaccgataatattgctaatggtgttagtgtattgtttagtattgattggcaaggggcgtttaaattaattgatattatgcgagaacatgtggtgagtatattcatattacctccatctatggaagagttgcaaaggcgactatataatcgtagtggagaaagcgatgtaataaataaaagattaggagaagctgcttttgaaattagtcattgttatcgttatgactatgttattgttaaccatgatattgaacaaagtgtttatcagattaaatgtatttttacttcagaaaaattgaaaacgcaacgtagggtatctctaaaacaatttattgataattgtatcagatgattgtaactcatcataaatttataacctaacgttattatttattttattaagtagatgataaaataaaaaatgttatttactaaatcctaattatttgttctgtttgtagtgtttttttagataaaggaaaacatgatttctgaaattttgaacttgattgatatttgtgtgtaaatcaggaacattttgtatgataagaggtgaatgatagtaaatgtaaaatggcatttatgagagtaaaactgcattaagttgaaaatggatatgacaaaaatagtttgaaaagttatgtaaattattattgtgtctgtatgtagtaaatcaggaacattttgtatgataataagtaaatgatagtaaatgtaaaatggcatttatgagagtaaaactgcattaagttgaaaatggatatgaagaaaatagtttgaaaagttatataaattattgttgcagttggtattagttattagtgtttgttgaagttttatgtgaaatgtactagtctgtaaatgataatcacaatttttggactctaatggaagagaatattataaatggaaaagtcatcgctgaggatattactagtacacttgctgtatgtattaatgatttaaaagtacagcataatgtaacaccatgtttgatagttatacttgttggtgatgatcctgcaagtcatttgtatgtgcgcaataaacagcgtaaagcagagatgttgggactaagatctgaaactatgttattgccaagcacaacatcagaaagcagtttaattgatacaatacgtaggttaaataatgatgatagtgttcatggaattttagtgcagcttcctgtaccaaagcatattgataagaatttaataattaatactattgatccaaggaaggatgttgatggattccataatgaaaatgttggaaggttgtttactggacaaaagaaagattgtctaataccttgtactcctagaggatgtctttatttgattaaaactgtaactcgtaatttatctggaagtgatgctgtagttataggaaggtcaaatatagtaggtaaacctatggcttgtttattgttgggggaaaattgtactgttacaacagttcactcagctactcgtaacttacctgattattgttctaaagctgatgttttggtagctgctgttggtatacctcattttgttaagtcttcttggattaaacctggagcaattgttatagatgttggtattaatgctatagaggaaggtggagttaaaaagtttgtaggagatgttgatttttctgaagctagaaatatagcttcagctattactccggttcctggtggtgtaggacctatgaccatagcatttttaatggttaatactgtaatagcagcatgtaatcaagctggtattgagaattttgttgaaaagtatttagatttgtaattctttaattgcagtaaattcatttatggtttataactaaataataagggcggttagctcagttggtagagcgtctcgtttacaccgagagggtcagcagttcgagtctgttatcgcccactccattcttttttctttgttttatttaagtcttgtgtagaggtatgtagtactttctcttattctataatggtaagtatattagaaattaatatcaaaaagttgaaacatattatttagtttcttatgtttttgtatgtagagataactatgactgtactttttatgggaagttttatatgaaagacttataggaatttacttaatatagtaagttaaatactgtgaaggtattttaaaaatttttatgaaaagaaagataatgattttgaacaaatttgcctataaaacttttataaagaggtaagatcttattccagttatttttatgtgaacgtgtttctaacgtttaactattgataatgagaattcttatgtattgaattagtatgtattcttataagttagtaaagaggtgagtgttatctgttagttatgtattaataaaatgattatttaatatgtacttattgagaatacagcatatagttaatgctttcattttcctattttacctgtatactctgctctactgcttctttaatgtacttaaatataatatttaatgaagtatcatctgataagttatggttagctgactttattaagtgtaagttgacattatctgattttattttctctgctacagttatggaagtttgatatggaactgtgtcatcattcattccatgaataagggtgatagggcaagtaatgttgatagattcttgatttaataataagtgcttacgtccatcttctattaagttacgagttattacataagaatacatgttattgctgttttgagatagagtgatttgtccatatttatatagttcatctttttgttgtgtatttaatttttgaaaaattaaagattcagtaaagtcgggggcaccagctagactgattaagtgagatactttgtcttgatgagatattgctactaataacataagccatgctcccatactggaccctatgataattttgggtctattagtaggagttaattgtgttatgatctctatgcagtttttgtaccaatcactaatgttgtagtcagtaaattgaccatctgattgtccatgccctaagtaatcaaataaaattaaccctaagttatgtgatttgcagtagtcgtataaagcagttgctttagtaccttgcatattggaattaaatccaccgaaaaatataatggatgctttatttcctagcaattgcctataagtaatgtgtaaaccttgtggattagataatactaacttgtaatggtcagacatattttacctgaagttattccaaagatttcaagtatgcaattaagtctgctacgtcttggggctttgaaataccagcaaatgccatgcgtgtacctttaatataagcttgaggttttgttaaaaactgaaatagatcttgatattcccatgtgccgcccttgcttagcattgctttcgagtaattgaagctgtcccctagatgtgcttttttgttgcctacaatgtgccataaatttggtcctactctatttgctcctcctttttcaaaagtatgacaagatatgcacttttttgtgagatctttgccttttgcaatattagcttgtgctattagagattcaatgtcgatttgttcttcagtattattgacttctgttggaatatgttcttctatatttattttataaccttttgtctgttcagcatgtggatcgggatcgtataataaatttaccacattgctaataaacagtactataaatgatgcaaataaaatggctgtaaatatcttgtttaagtggaatccgtccatggctattgcattcctagattataagaaatatactgtacacttttagagtaatataatcattaactgtagtcaataaataacattatttctttattaatatagatgataatcttaatctataagcggcatatgcttaatgtgcagtactttaattactatgctatatcatattaaaattttattaagttttatagttaacttaaattaagtgatagctttataatataaataataactctagctgtgtagtgacgtgaaattacatgtatatgacttttatttaaaaaatatcaaaaatcatatccgggaaaaagaatagtaatagtgtgcatactgcggttgtaactatagatataagcattggtactggggcttctgcatacttaaaattataagatgtagaaaatgcattatatataatagggagaaaatatattgtatttaatacagtgcttgatactaatactaatgctactgtgatattattctgacttaatgcttctgagagaataaagaactttccccaaaatgtaggagcaggaggtatacctatcattgcaatggctccaatagaaaatgcaaccatagtaataggcattgatatacctattccatgaagttcatataagtattttttccctgtttttgtgtatattgctcctgcagcaaaaaataatgtgatttttgcaaaagcatgcgatatcatttggaatatagagaccttaattgcatactctgtatataatgatgctgccattactatgtatgagagttgtgatattgttgaatatgcaagtaacttttttaggttagtttgtttaattgctgttaaggatgctaatataattgtgattcctgaaatatacataattatattattgtgttcttggacaagtgtgtttaacttttctaatcctataatgtataataggattttgattatggtaaatactccggattttacgactgctacagcatgtaataatgcgctaactggagtaggggctaccatggcttgtggtaaccataaatgtgtaggcattaatgcggcttttccaattccataaattaatagtagtaataaccccatgagtaaactgctggagatatttgttggtaatataccatttgtggtaaaatctagtgtgccacttacattatatattattaaaattgctggtaaaaataacagcattgaagttcctaataatattcctatatagtatctgccagaaatttgtgactgagtgttgatatggtatgtaatgagtgggtatgtacttatggtcaataattcataaaatataaatagtgtgagtagatttgctgaaaatgctatacccattgtacatccaatgctcattgcaaaacatgcataaaatatgggttgtttgctgttgtttgtatcattttttttcatgtaactgatactatagatggtagtgattacccataaaaatgaagctaacaagccaaatattatgcttaatgtttcagtttttaatgcaatttgtatctgaggatcaatgaattcatataattttatacataactctgaattattattcatgagctgcagtttatatgtttcaaatactgagtagaataaggtacatgaggaaaatatacttataacttcttgtgcatatttagttttctttaatattaatattaaaaaagcagatgtaaatggtagtaaaactatagatagtaaagaaaatcctgatgttaaatccttaagaaaatgcattgattctattattgctgtatttagactatagataacaataaagctttttaaagtaaagtatcttatatagtattttctttcaatatcaattttaatctcggaatctcatcgaaaacattttgtgtgtagtaaatcatgtatgtatacgaaaattagttataaattataaataaatttagttacttttataattcttgaagctatataagtttatctatatttttatgtagtttgtttagttgttcctatattgtttgttacatagcaaaattttttacaaattcattaaagtatatgtagaataacacttctgccattgcatgatctgctgaaattaggtgtccatcgatttctactgtgtctattatgaagtttttatctgcatgtatgcaatcagaccacgggcctcctaattgtgcaattatattattaatagaagatttaacttttttataatctattgcaacgttgtaccatttttttaaattgtggggtttaggtaatttgccaccaattcctacacgtgatactgggtcaattgtacataataaatctatggtatttgttttaagtgtttttatgactttgtatccagtgtctcctccccaactatgtcccacaaggcaaattttttgctgtgcttcgtaccaggcttttattattgggattattgctgatgatccccaagttgcatatgctatatcttggtgattatggttctgtgtgtaatatttggcatataagtgtaatacaagtcttgttgtatcatctaatgctcccccaataaatattactaaaggttttgtgcctggagtaattttacttcttaaaatttcttttgaatttctagggattgcaatgccatctgtactatatcctcttcctgttcctactgctggaatatatggtggtatgattttatcggcaacaaacatgagcatttttatttaccttgaatgataacatgtgtcaacgttactacagtgaatggttttaggaaatatttagattaaaaagtaaattttgtttgtattacaattaaagcaatgataatagaatgaggattaaaaaaatagttatgtgattttttataattacagtgtcatctataaaatgtaattgtattttaacatatcatggtattgaaagaaaaaggaactttcgtctctggtagaaatacgcacaaaaaagtctcttaattagtaggtatggataaactcatagccatctattattctacactctgttcataatagcagcttgtgcagctattaaccttgctgttggaattctatatggagaacaagaaatataatttagattcagttttgcaaagaattgtatggaatcaaagttcccaccatgttctccgcatataccgattttaatattcggagaagatttcctacccaaatctacagcaattgatattaatttacctactccttcaatatctaaggtttcaaaagggtcttgttttattatttctaaatccttatatatttcaataaagcttgcagaatcatctctagatactcctaaagtagtttgagtaagatcgtttgttccaaaactaaaaaattgagcatgttgagcaattttatctgcaattagagctgctttgggtaactctatcattgtccctattgaatactttggattattaaattgctgtgctacattactaattaattctttaatgataacaagctctttttcattcataactaggggtatcattatttcaggcactattcctgttatgtctgtttcttcttgtagttcttttattgcgagaaagattgccctaacttgcatttcatatatttcagggtatgatatagcaagtctgcatccacgatgtcccagcattggattcttttcagataagtatagaaccttgttccttaatttctctaaagatttaccagttcttactgaaacttcatttattgcattgtcattatctggaagaaattcatgtaatggagggtcgagtaatctaatggtcacttgcttattgattgtagatttgaagatttttttaaaatcttctttctgcataacttcaagtttttctagtgctgctattctctcttcttttgtatcagatacaatcatttcttgtacaatacttattctcttgtcagaaaaaaacatatgttctgtgcgacataatcctattccatcggcttggaagttcatagctatatctgtatcttctggggtatcagcatttgccattactttgagtattcttatttcatctacccactgcattagtttgtaaaaactctcacttaatttaggggtgactgtttttatagttcctagaattacttctccattacatccatttattgtgatgttgtcacccttatgtactttaagtcctgtgttcgtataaaaaaattgctcactcttatctataaatatcccatttgcactacagatacagggcttacccatacccctggctactactgctgcatgagaggtcattccacctcttaatgtgataatacctacagaactgttcattccatttatatcttctggattggtttcttggcgtattagtatagcattttttccgtcttttctgaattgttctgcatcattaggggtaaatgctgcatatccagttgctgcacccggagatgctggtagccctcgtgcgataatattgatatttgtattattttcaagtattggatggaataacttactgaatgatttgtaatcaattcttagtattgcttcttctcttgaaattaatttttcttctaccatgtctactgctattttgacggcagattgaatactgcgttttcctggtctagactgtaaaatccataacttaccgttttctattgtaaattctacatcttgcatttcacggtaatgtagttctagtttttgacataccttttctaaatcactgtaaggttgtggcattaattcctgcattttatttagtggtaatggaatatgagttccagatactacatcttctccttgtgcgtttactaaaaattctccaaagatttctttttctccagttgatggattacgggtaaatacaacgcctgtagcagaattttgactcatattaccaaataccatggattgtacgttaacagctgttcctaaattatccggtatgttgtgtatttttctatatataaccgctcgtttattcatccatgatctgaaaactgcgtctattgaattatatagttgttcatgaacatcttgaggaaaatctttgttagtatgagtactgactatttttttaaattcaattattatttcttttagtatattggggtctgatatttgactatttactgggataccagcttctcttttttttttacatattacttcttcaaataaattactctctatttgtaatactgtatgtgcatacatctgtatgagtctacggtaactatcataagcaaagaattcaccacttttttttgctaaccctattactgtgttatcatttaatcctacatttaatattgtatctagcattcccggcatagagctaacacttcctgatcttactgagaatagaagaggattatcgttatcaccaaattttaaatttacttcattatttaaaaattcaatagcattttctaccaagctgaatatgttatcaggtaacttactgtgttgataataatagttgcatacagctgttgatactgtaaacccaggtggtacatctacaccaatattacacatttctgctagatttgcgcctttaccacctaggatatgacttaatgtaagacttccatcacactttgttttactaaaataatatattaatttttcactcatatgaagagaaccgaaaaaattgtgtttttatgctataatagtcatttatactacattcgctgaatatactataaaacctaattctccatagtgcaactattgtgaaataattaattaagtatgtgtaatgtcaaaataaacagtgatgtttcatgtatatcaataaatgctatattttgtatatagtgtttatgaagagtaacgcgttggtagtgaaggttatgtaaacgtataaagtaacatgtgtgttataaatactgtacttgtggtaatgatataaaataacaagtgtgttctttatcaattatgataatctaagtaggtgtaaggattagtgtgttgtatatggtactataatactagtatgatatgacttgtatgtttttgttgacagagtagtatatcagaggttactcattatctactaccatggtgttaaacatgatatcatgtaaggtttgattcttttgtgaaaataacgcaattaaataccaacatgttgatgttacaaatgttaccatggtaatcaaaaatataatacttactataaaaatattattaatgttcatatttattgcttgtatgctcatcatcaggatagtagggcagagaaattctgataatgatctatcaaatgctagccgaatatcaatttttttatgatcacaacgtatagtgtgtatgtttaatattttttgtccaatagatgcttgtgttttggaggataaaaaatatgtgtaatagtaacaactacttaatacattaaaaataaatggtataattgttatatcgtttgttaacagtacaatggggtagttaagtaatgatagaattacatggtcaataatgcttgccaataccctttttattatatttgcggttttagttttttttatagtcatatatttattaattgacagataaagttacgaatatcataaaaatttttaaaagaaagaatatcctttataatattggtgctaccgtattttatgggtaggcatcccgcttcaattgcactttgtatatctgatatactatctcctatgaaaaatacttctttgcttggttcaatatttatatttgtcaatgctgctaatactggttcaggggatggttttatagttcctgtatctccagagccgatgatagagtcaaaatagtgtgttagatttttatgatgtatttcagatcgtaaacgttcaccattcttattgcttacaattgccatggtgatattattttcttttagtgtatctaataattcaatagctccatcattcagcatgaaattgtctgatttttgtgatttctctagactgttctcatacaagatggttgcttctttccaccttttccctagtaatgtgattagatattttggtattgtagaattgggaatagagtccagatctatatttttatatcccatctgatccaatacttggtaaaaagttgtacgatcgatattaatactggtatcaattagtgtattgtaccaatcgaatattactgctgttggttgtttcatcgtttatttagatttctaaaattaccattcttgtaatacatgtattaagattctatgaaagtcaggattattttcaatgtttaattgaacattaattacaagaatcataattataaatgtagtgtattgcttataaaacaaataatatgcttaccattagtgtagcattttgtaccacctgtcacaaaatcaagctctctttctttaaacacttcacccaaagccttagaattttttattatttgttttgcataatctttaaactcaggcttcaatgcttctgcaaatgctacagctttagcaacaataacatgcattagtggcgttgtgattatgtactactaatggtacactacatcacatggaaatattgtgtaatattaagacttctttgtaatgcttagtgatagtaattttaaatgttccttatctatttctgatggagcactcatgagtaagtcttctccggattgatttaacgggaaacaaattacttctctaatgtttgttgcgtctgctagtaacattaccatacggtctattcctggggcaatccctccatgtggaggtgcaccaaatttgaaagcacgagttagggaattaaatttttggtctaccatttctttggtatacccggctatagaaaatgctttgtacatgatgtcgagtttatggttgcgaatagcaccgcttgagatttctataccgttgcaaactatgtcatattgatatgcaagtatatctagaggattttgattatttaaagcttctaaccctccttgtggcattgaaaaaggattgtggaaaaagttaatagacttttcctttttatcatatttaaaatatgggaagtcaataatccagcaaaatctaaaggtgtctttttcaattagattaagttcttttcctaatagagttcttacttctcctgcaagttctgtagctttatcttctgtttctgatacgaaaaatacactatctccgggttgtaaattacaaatagatttgattctatttaatctttcttcgtctagaaacttagctataggtccttttgcagaaaaatcatcattaaaagtaatatatcctagtccttgtgcccctaatgtttttgcaaattcaatcttattatcaaagaaacttcgcgggttggttgctgtattaggtgctggtattgctcgtactaccattccttgttttatatttgaattaaatatgttaaattgagaatccctaaatatttcagtaacatcctgaattatcaatggatttcgtagatctggtttatctgatccataatgtaacattgcatcatggtatgatattcttggaaattccttatcaatagttttgtttgaaaacttgctaaatacattaagtaatactggttcaatcacattaaatacatcttcttgactaacaaaagacatttcaatgtctaattgataaaattctcctggtgagcggtctgaccttgcatcttcatccctgaaacaaggtgctatttgaaagtatttatcaaatccactaaccattaatatctgtttaaacagttgtggagcttgaggtaaagcataaaactttccatgatgaatgcgacttggcactaaatagtctcttgctccctctggagatgatgatgttaaaataggagtttgtatttcaatgaaacccatggcttccatgcttttccgtagttctgaaatgattttagatcttaaaataatattgttttttactttatcacgtcttaaatccaggaacctatacttaagccttatttcttcaggataatcttgtgttgatgtaatgtttaatggtagagggtctgcttctccttcaataatgacatgttttactacaacttcaataaatccagtactgactgcggtatttatagtagagctgtctctggctactactattccttttactgtaataacactttctaatcttaagtgagtaattaattgaaaattttgattatcagcttcattgaatactaattgtgtaattccataatgatcgcgtagatctacaaaaataattttcccatggtcacgctttctgtatatccatccagaaagagtaacctcctgatttatatgttctttccttagctgatcgcatagatgtgttctatatatgttcataagatctatatttttaatgtcaatctattttatacaataatgcatacattaaaagtatttttggaagattgttattaaataatttttgggatttgtgttttagttttcctttttaagaaagctaaatcttcaggaaatgtatttgctgtaaaattgtaattggtatttaaagtataaaatttgtatttataaatattacaatcaacatatgatttctacaaatctagttagtgagtttgattattatgtgttttgtaatccttagtgtgtggttcttactaaattttcaatgaaacttataattactaaagtgttaaagtatactatattttaaaaaggtataaaatattttactatttacacactataaaaagttgtatagcataaccctgtcgctttatgcttttactgttccatatgcgttttctagtaaattttttgttgctaatttttttaattataagccagtctggttgttcagggataatggctgggcttgctgttactacaggtgcaattattacattacaagataaatcagttggtgatactatagatgatacagcaatattgattagaattaataaagagctatttaaggcagggttatttcctcaggtaactgttaaggttagtgaagggcgtatattattgataggacacgtgaaatcattggatgatcaaataaaagctgaaaaagttgcatggcagcagaaggatgtaagagaagtggtgaatgaaataactgtagataaaaatgcaattaatataaaagaaacagctgttgatactatgattagtgctcaggtaaaagcacggatcctttctcaaagtaaagttaagtctatgaattatagtgttaatacaataaatgggactgtttatttaatgggtatagctcaagatcaggaggagttggataaggttgtatcaatagcgcaaaaagtcaaaaaagtaaaacaagttattagttatgtaagattaaaggatagcaagttacgtgattaatcatctacttcaattttatatacgctgttttttacaataagtaattttacattactgtaggactataaataaatgtgtgaattacatacgtatgacatataattaatacatgtttaaaatgtacttttgtattgtaatatgtgattaattcttcatttaatataagtatgtctttaagttttaaatgttgtgtttaatatcttccaagttttttatgctagtttgctgaatcaaggtcttttttgtgaatgcttaatataagatagcatatgaactagtatgttgtttacgtcatgatcttttatatttcgatatcttaagaattttgttattctcattcaataaagtaagggttataagaagctatcggcttagtagagaaatataagaggtaatatatggcactaattgttgcttttcaaatggataaagatgttgttgttgataaggatatgtcagttaaatttatacaagaagcgcaaaatagggggcatactgtattcttttattctcctaatcaattagcagtaaaagataacatgccaattgccagagcatgcttggtaactatagaaggtcaagaactacgatttgctgatgtacaagaattgttgcttgaagatgttaatataatttttgtgcgtcaaaacccaccatttgacatgcgttatattacaagtacatatattttagaaagattaaaaagaccacttgtgataaataaccctaaaagtcttagagatcatacagaaaaattattaccactttcattccctgaatttataccagatactatagttactgaagattatattatgttgcaggatttctataataaacataaggatatagtgttaaagcctttatatagttatggtggaaatgatgttactagaatgcatagtaatgttgatattggggttatagcgaaattaatgacagaaaaatatggatgccctataattgctcaaaaatttataccaaatgtcagtaacgataagagaattattcttttggatggtaagcctataggagtttttaaacgtagaatatcatttaatggaattaatgaagaaataagaactaatttgcgaatgggatcagttccagaagttgcaacattgtcagatcgagatatagctatatgttcagctatagaacaagagttgttgggcaaaggaatggtatttgttggaattgatgtgttagatgggtatttgatagaaataaatgttacttctccatgtggtattttacaaattaatgagttgtatggtgtgtctttagaaaaaaaatgttgggattgttttgaagagaagttttatgaaaaacataatagtatatagattatgctgtttgtaaaaactagtaactttaatagtgcttctattatttgaattgaatataataacgtattaataaaaattttctgactatagggataaatgcatttagtttaatgttgtgtatttattttgatgatggttatttgatatcaagaagttgaaattagttctaaaaaattttctataccgtctttattaacatattactttaaatttttacttctcatactaatttattataacttttttatatcaaagataaatatcgattgttttgctatgttataaaaattccaagtttagataagtatatttgtggtattattttttattatctcttagtaaagggttatgttttaatttgatattgtacataatttagctttatgtaatgtgtagtctgtagtggtttgtgttgaccttaattgcataaatagtatttattacttgaaaagtttatataaatgttttaatcactgaaatgttctattgatatttttaggagttgagtttcttgtataaacgattgttcatgcatatattaatttttattattgaagttttatctggcatgatttgcttttaatagttaatgctttaaattaagttgttaaatctttaattaaaagaattatggtgttattatgagtgaaattagtaatcttaaagatatagttaattatcagtctttaagcaatgttaatagtatcagtagccttaatattcttaagtcgaccagggttttttttatacgtaagaattttattttcttagtgatcattattcttagtatgttctttacttatttttttaaaggaaaaataattaatgggttacaaaattgtgctgtggttctatcgaatcagttagttaattatgggtttgctgttgaaagggtagttattgatggaaataaatttgttacttcagactatatagaaaaattcattgatattgataaatctattttatttatatctttaagtgaattgcagaagaagataaagagtaataataaatggattaaagatgtttcagtgaaacgattattacctaatgttttacagataaaagttctagaatatttgccttttgcgaattggtatcataattatggtagttcaattattgatgatacaggacatgttattgttgatagtgaagaagaagaagatgatttaatatcaatatatggtaatgaagcgttgaaagatttacatttcataaaaaaactacttaatgagaatagtgttctcagtaatatgatttcttctatgtcttatgttgatggtggtcgttgggatattgttttatctagcggagtaaacattaagttacctaaggaaaatcctcataatgcttggaatagtttactgagtatatatgaagcttctaatgaatttttaatttggaagagtgtggatatgcgtatccctagtcaaattaatataatagaataatttattaacgattagttataatgtatttataaaattgataataaattatatattgctatgtttgtttatccgtttggatgtataggaatcctatgtttgataaattaatgataattgtaataaatttttattatatgtttaaaatttatagattaaaaataacgaattttatatattggttgttgatcattaatgtgtatagtagtattattaagtgtacttatatagagtacactgtgttttgtggtgtttcatcagtattgtaggtaattatggcacagaattttgaaatgtccaaagaaagattgtatatttctgaagtattggttgttgatgatgaagttgatattaggaatttaataaaggatatattaagtgatgataattatgtcacaaaattagcagttgatgggttgtctgctattaagatggcttatgagaaagaaccagatgttgttttactagatatatggttaaaaggatcagatattgatgggttaagtgttttagagaaactaaaggaaaggtatccatatttacctgtgattatgattagtggacatggtaatattgctactgctgtgaagtctttgcacatgggagcttatgattatatagagaaaccttttacagaaggtagattaaagttagtagttaagagagcgatagaatctggtagattgcgtagagaaaatgacgaattaaaatcaacatttgaagattacgaaatagttggcaactctcctgtaataaaaaatctaaggagtatgattaataaagctgctacaacgtccagtcgcattttaatcactggatcgcctggcgtaggaaaagaagtagttgctagattaatacataaaaaatcaaaaggatatgatacaccgtttatatcgatgtattcatctatgttgcctgcaaataattacttagttaatatatttggtagtgaggaaagcagtaacattttgtctcatagggtaccacctcatattggcataatagaacaagcaaatcatggaacactctttatagatgaggttacagatttaagatatgatactcagttacgattacttaggttattgcaagaaggaaaaatatacagagagaatagcaaaattcctgtaagtgtagatgtgaggattattgtttcatcttcaaaagatatagaaaatgaagtaagagctgggaagttttgtgaggatttatattatagattgaatgttcttccaattagagtaccgtctctagtagagtattgtactgatattccagagctgtgtagatattttatgagtagcatatgtaagaaaataggattgtgtacacatatattgagtgatgaagctttaatagcgatgcaatcttatgaatggccaggtaacttacgtcaattacgtaatgttatagagtggatattaattatgaaatctcctaaagaaattattactgcaaaagatttgccggtagatatagtatcgaattctcctatcaatgatgttctgagtgctaaagtcatatctgttcctcttcgccaagcacgtgaggagtttgaaagacagtatttgaaaactcagttgtcacgttttggaggtaatgtgtcaaaaactgctgaatttgttggtatggagcgttccgcacttcatcgcaaattgaaagttttaggattgtgtagtatatctgagtaacttatattatgtgatgttagaattagttttttaactgtgtatgtgttgttttaattaagacgataagttatatataaccaagaatactgcatcttatagtgtagcttattaaataatttgtgtagttttttactagtttctaaaattagtatgtcatagctgatattattttcagtgatgttcttacgccgaagataagtatacaaatatgtaattttattagtcatgtgttttttatctaaaatatgcattctgtttttataatagcttagcacaagttgagtgttataatatgtctgatattgttttctctaacggtatatttttataaagtaagttatatatagatgtacaaataggtaattctatattaagttcttttgctagtgatattaatggttttacagtactaacaccttctataatttttgagttattatttaacattttatttatatctgcaccctggcctattgttattccaaaagacatattccgggaatgtgctgttgtacaagttaatatcaaatcacctaggcacgatggaccaattaaagttgagaggttaatgttctggttttttgcagcatacaaagtctttatttcttccattcctttagttataacagtggctatagcattgtttcctaggttcttgcctgttactatcccgcaggcaattgcgatgatgtttttcaatgcggctccaatttgtacccctaatatgtcttggctatagattattttaaacgtcttgttgcttatcttttgtgctattgatgtacctaaagattcattttctcctgcaagcactatggtgcatggaagatcttctgcaatttcttttgcgaagcttggtccagatagtatgaatgctggattgtttggtaagatttctttcactatttcacttgggaatttgagagatatattttcgattcctttactgcaaattagtagaggtgttttttcaaatatatgttgtttgtcttgtatagacagacataatgtacgtaattgttgtgtaggtactgctaaaataatacaagtgctataatctgatagtacttcatctatgttactgcttacaattatattttctggtaatttgcacgttggcaagtatttaagatttttacgattaattgctatagattgcatatctgtatgattgcgcccccataggttgactgatgtactattagaagataatgcaaatgctattgctgtaccaaatgatcctgcacctaaaatagtggttttcatttttttgtctacttataaagaacttagttagaggcgattatatattatatattatgtggtgttaagaactgaattgggggttaatttataatattggtaataaacatttaaaatattagcagggataatttaatattctacattttgtgtttttataatttgcgtctattataggttaaaatttttagcatatgaaagatcaaaagctgtgtattgttgtaaatgaatgggtgtcttggataaaaaaagaaagaagatatgcgactaatactgttgattcttatctaagagatgttaataagtttattgagtttttgtatatgtgtgttttgcgtcctgttactttagaggatattattggtgtaaaagttgcagatttaaggaaatggtttgcatttagataccaggctaatatagaagctgtaacaaatgcaagatctttgtcagcattgaaaaatttttttcggtatttgtcacgtacttataatatagatggtcaagcagtgttttgtttatctagaccaaaacttaaaagtactttacctagaacattaactcaatctcacattcaaaaaataatagattattatgcgttattagataccgattggatagtcaagcgtgattttgcactaattgtgctcctctatggatgtggtttgagaattagtgaggcagtgaatttaaagtttcagaatattagaagagaggagcttttaattattgggaaaagaagtaaggaaaggatcttacctattttgcctatagtacgtcaaagtttagatgagtatgtaaggtgttgtccatatcatatggaattgaactcagttaaaaatgaatatgtttttgtaggagttagaggcaaaaaacttaaaaggacttattttgcaaatagaatacaaaagatttgtaaagaaatagggttgcctgatgttataactcctcatgcatttcgtcatagttttgcaacacatttatttctaggtggtgcggatattagatcaatacaagaattgttaggccatgctaatttatcaactacgcaaatttatactcatttagatcataaaagtgttatagatcattataagaatttccatcctcaagttataaaaaagaatagttgataagtacaagtcgagaaatgagagtatggttttgataaaagtgattatggaacaagttttttctgtatcttatattagtaataaaatgcgttacattgtttagtttatgtagtttagttatatgcttggtattactaacataaatttgttatttagaattaatgtgttttaatcattagtatttttaatgtttgacacaatacttattaagatattgcataatcttctgtatattttcatgtgatattgtcagttttacatgtcagatctttttaaagttgatacaattgcgttatttagaattaatgtgttttaatcattagtatttttaatgtttggcacaatacttattaaaatattgcataatcttctgtatattttcatgtagtattgtcaattttatatgtcagatctttttaaagttgatacaattgcgttatttagaattaatgtgttttaatcattagtatttttaatgtttggcacaatacttattaaaatattgcataatcttctgtatattttcatgtagtattgtcaattttatatgtcagatctttttaaagttgatacgattgcgttatttagaattaatgtgttttaatcgttagtatttttaatatttgacacaatacttattaaaatattgcataatcttctgtatattttcatgtagtattgtcaattttatatatcagacctttaaaagttgatacaattgtatttatttgaatattacttgatcttcagtatttctttctgtgatttctccaattttgtatacaacttcatctgtaactttgaggagtgacaatacttgatcttcattttcttgtgaagtgaccagtatcataccaataccacaattgaatgttttgagtagttctgtttgctgtatttgtacttcagtattaagccaatgaaatatttctggcattttccaagaacttaagtcaatagttgctgacaaatggctaggaataatacgtggtatgttatatgtgaatcctcctccagtaatatgagctaaaccattcactaatggaatagtagataataaagattttacatagatgcgtgtaggcgtcagcaaatagtttgcccatgtttgattagaccaaggacatacatcatgatagttaattttattgtcactgataatttttctgattagtgaaaaaccattggaatgtaatccacttgaagctaagccaagtattttatctccaactttaatattatgactttttggtaaaatgttgtctgcttcgataatgcctactgcaaaaccagctaaatcatatttattgtcactgtacattccaggcatttcagcggtttctccacctattaatgctacatttgcttttttacatcctactgctatgctattaatgatttctaaagcagtatcatggtttactttacctgttgcaaaataatctaggaaaaataatggttctgctccctgtgctaaaacatcattaacacacattgctacgagatctataccaatagttttatgattatctactccttgtgcaatacataactttgtgccaactccatcagttgaagatactaggacgggtttgttgtattcttttattcttgatatgtcaaaaagtgctccaaaggaccctatactgtcaactacccctggtatagatgttgatgatgcaattggttttattttttctactagactgtttccagattcaatattgacaccagcgcttgagtatgttttcataaatgccttactttgtgaaactcatttttacacttaattaacagcatagcattaaatatttgaacttcatataaaaaattgtttactaattagtgagattatttttttttgatatattaaaattggaaaacgtgatgttgaatatagggtttttatgcaaaatagtgatattttatcaaatatagaattagtatctgcaaggctgttacatgatcttgcaggatctgtaggagcaatagtaaattatatagaatgtttgagtgaagatgaaagtgtatctgaagatatggtacctttactttctgatgcggctaatgatgtaatgaataagtttaagttattgaagcaagcttatagtatttctgatgataatggtgattttaatactactgaacataatataaaaaattatctaaaaagaaaaaaaatcgttcttgagtgggatattaatgcacaaatttttgatgttgaattggttgagaaaatcaataagttacttattaatgtaactatgatattaatgttctttatgataaatggaactaaagtgaaagttgtattatctaaatcaaataataatgattttttgatagaaataatagcttttgcacaaaaaatagaaatacatgagagtattcaaagtattcttgatggagatatgtttaatcaggagttaaatacaaaaaatgttcaagtaaattttctgatgatgcttttaaagagttataatgcaaaaatgacatatgaaatacaggatactatatttaaattttctatatttatttagtgataaacttactgttagtacattaggcatttgtgcagtatttatgtaagttatggtaactttggggtacagtttatctttgtaaaatatagaaaaactataaaagtaaggtatcagctactaaatgaaaaatttagtaagtgtatttatgaaatgttagtacttttaattgtgcctccacctgcttcttgttgtgcaataaatagtacattacttatatttgttaagagttgtactgagtcaatttcgttatacatttgagcatagcctactgagatctttgcatgtgaatcttgaaggttattgttaatgttcttatgtattctagatattgctgaatatgcatgttcagatttacatcctaataaaatacaaataatcttatggttccctatatacccaattatatcactttctctaatgtttttatgtaataaattaatagtttgttgtgttaaagagtctatattggagctattatgtggtgggtctagttgtatcatacttataacggcatgtgtattatatttatggagaaaatctaatatgatctgtacttctgtctttgtggatgcttcatccattatattaaaagtagggtgcatattgtattttgtattgaaaattactgattctttaaatatatccaacttttgtgatatgctaatatctcgtattaggatttcatagtttattatatcttgattagaagctatgactctaaaaacttttggtgtgactggtattgctttgttatttttcccaataaaagaacaattgcgtgtttttgataaaatgtcaaataagtcagttccatcacttgtatattctaaatagctatttatattttccacaatatttttatgtagtatggttgataatggtttattagaaagttcttctactgtatattctaagagtatttctgctggtttattcaggttagaaattgttaaattttgcaaagtgttgttttgttgtactgatattacagagtcatcagatcttcttgcaaccacgaagtgattcatgtttttctcgttttatcaattaaacattgcattaaaatctgtttgttgtcccatttgtataaaaatttttctttgttattttattcatgatttgtagttaatgaattattcataaggtatttttattacataatgagttctggtatgttttttattatgtaattatttaaatatttatatgggtatagtttagaaaaagttaggatatagcttattattttggtgggtaggactaatatagaaatgagatgagccttgcatgctgtactcttcttgtgagttttaagatttatttttaaataggactgcttaatatgaaatcgatcaaatgtgttaaaaattacgtgtattgggtctatctaattaaccctaataaatactcgttgtattaaaaatgttgtgttatggttgacatatcacaatttttcattttcttcatgtacttgagaattccatagattttcaagttgataatattctcttacttcaggtctgaagatatgtattaatatgttatagcagtttattactacccagttgccatcttttaagccttcaatggatagttttttatgaggcttaatttctttcctaattctttcagctagtgatttaacatggtagcttgattcacctgaagcaattattaaatgttctgctaagttgcttttattactaatattaattgtaacaatgttattagctttatgtttatcaaggataaatactataagctcttttagctcttctggagaactaaatggttttttagatttactgagattcattttacatcgttctttagtatactatatctattgtattacatattggatgtaatacaaacagttaaaaaatgttaaaagaaatgtgtttatgataaaacttgtctatattattaacagttgctaatgatgtagtggattgttaattttcttagaaggtgatctacaatatgtataatatatttcagtaaatatggaagttggttaacttatgaatattaaaagcgtgatattatttctaagtattttgctttatagcaatgtatcattttgtcaagatggttacatgatatttagagatagtgaagtcgaggctgtaataaagaaaatagcatttccaatatttattgcagctaaaattaatcctgagactgttagagtgtttattgttaatgataaaatggtaaatgcttatgttgatggtaataataatgatgtgtttttgaattatgggttatttgagttttcaaatgatcctagtgtacttattggggttttagcccatgaagttggtcatatatctcaaaaacatgtgttattccgtagaagtaaagtacaaaattctatgattttgtctgggataggatatgttctaggtattattactgcaattacagtaaatcctgatatgggacaggcaatagcacttgctactaatgatattagtaaaaaaatgttttttctttatagtcgtttacaggaggcgtctgcagatcaatgtgcattaagatatttagatgaagctgggtatagcaacgatggattaattaaaatgtttaagcatttttattcactggaagcacaatatcgaggaaatattgatcaatacttattatcgcatcctcttagttatgataggctgttgcaaatacaaaattatcgcaatcgtaatgaggttcatggtttttctgatgaagatgtacagaaatttaagcgagtagtagaaaaaattaatgcgttttttaacccagtagaacgtttggttaatgataaaaatgatataaatcaattatctccatacatacaatctattattttttataagcaatctgatgtttcaaaagccttagaaaaacttgataatctaatactacaatcccctgaagatccttatctttatgagctgaaagcacaaattttgtataaggcaggtgacattaaaaagtctgtagaaaattataaattagcgcttaagttttctttcgatgatgttttaataaaacttgaaacatcacaagctttgttattgtatgatcagaaggaagcagtaaattatttggaacaagtgacataccaagaaccagataatgtttttgcttggaagcaattggctgtagcttatggtaaaataggggatttgggaatgtcgtatttttcactggcaaataaatctttttttgaaaataatagaagagattttgataaatactttagcttagcaagaaagtatttaccaaaagatagcgtacacttagaacgtatgcgtgatctaaggataaatttattaagtaatacataagttatttaaattactaataatattatttatattttaataaatatgtagtagtttattaccttatgctaaggtgtggtaattttaatgaagatacaaaatgctatattttttttgctaatgctgcaagcttcctgtagccctatttatggtattaaaaaagaatataaaggaccggaaaatgaatctggaaaagcttgtgtagtaaagtgtgcttacgtaagaaatgactgttataggcagtgccaagttgatatgacaaattgtcaattaactgaaaaaatgatcaatgctcaagagcgttctcaaccacttgtgagtataataaatagtaatggaaacaaacaaaataataacttgaagaataataatggtcacccatgtaaaagtgagaacataaaatgtaaggagtcttgttctagtgatattatgtgtaagactcaatgcgatatgtatatggatatgtgtaatgctcagcaaaattttaatggtcatgacaaatacgataactttgtttcaagtatagataaaaaaagcgcaaacatcacagtaagaaaacaaaattctattagcttatgcagtagtaataaatgtgatagattatgtacaaataattatgatttatgtttttctagttgtggtggacaaataattacttataaacagtgtgtagcattttgtgataaaaataaataattattttctacctttattgtataaataaaactaatgaataattttataaatagtttgtatttctagtgttaatgaaagttgtcattaccttgttagtatagtattgatgtggttgttttgtatttatgaaagttttttagttttatgataaatgagcatgtgcagtttacgttttttgattctgtagggcagattagtttttatttatgtaaagtttatctttttatggatatacttgtttaaaaatttgcatatttctgaatatgggtgttttggttagacatggggggatacataaaggattctgtgtgttagattacattgcatgtattgtagagttatggatgtgcttgtattaaattttcatatttctgagtataagtgttttgattagatgtaggagatacacaaggattctatgtgttagattgtgttgatatttgatataatattgcatgtatcgtatgaattatggatatgcttgtattaaatttgcatatttctgaatatggatgttttggttagacatggggggatacataaaggattctgtgtgttagattacattgcatgtattgtatgagttatggatgtgcttgtattaaattttcatatttctgaatatgagtgttttggtgagatgtaggagatatacaaaagattctgtgtgttaggttgtgttaatatttaatatagcagcatcctaagttgtgtgatttactggtgttatagtagttttgtgtatttttgaatatcagcagaaaataatattactgttgcaatacatgtgaattttgttttattaggttaatattatttagacttagaagcatttcatatattggtatttgtaatactggatgaatgaacctagcatagatatcacataatggtactaatacaaaatctctacaatgcatttgttgatgaggtatagataacgtttgtgaatccacaactttgtttccccacaatataatgtcaatatctataggtctaggtgcccaacgttgatgattaattctaccaagcattttttctatagatttaattctttctaacatggcagatgaagacaagtttgtatatcctgatactaccatatttaaataaggtgtatcccaatgatcagctgcattttctggtaataaagctggagttttataaagataagaataatttttgttatgtaaaggtaacatattaattgcggatttaatatatgccagcatgttgccgcagttacttcctaacgctaacattacaacatcgttaaacatatttttttttagttgtttaaaattacagggtatttcattttgaaagtaatttcaatgttattgtggtgcattaaagtgttatgtaaaaaattttaaagggattgtttataggtttaatttttttgtttgtattacttaaataatattattattttttttatatattactgatcatatatttgtgtatgattgtattttcatattactgaatttcttgtaattgtgttcaagtatgtttaaatcaatagaacatatatcttctataataagagtgtttgtagaggttactttgcctatgtttgcatatggaacttctttaaatattgcttcaaacctttgcttattgtgttctcctattgttactaagatcctgctttgtgattctgaaaataaaatgactttttctcttaaagtgttgttgtcaatattatatgttggtattgctgataagctaatctcagctccaagttgtcctccaataagtgattttattaaacttattatcatgcctcctaagttgactgcaattgctgatgctataagatttgtattgatggctttgttataagatatgtataattttttagcatgttcggcgtgtacttgtggtacattattatttcctagaccactgtatttttgatattcagaacttccaagctcatcataagttgtacctaatatgtatattaagtctcctgggcttttgacatcaagtgttacagcattctcaacattttcaatgattccaagagtagaaattaacaatgaagggggtgcggaaatattaatttctttgcctttgttattataccctttaaagtcattaaacatactgtctttaccagaaataaaaggtgttctaaatgctatagcatagtcataacatgcttgtgctgcattttttaattgccataatctttgtggatttgttgagtcacaccagcagaagttatctaataatgctaagtgattgaaatttcctcctactgcaatatagttacgtatggcagtgtctattgcacaggctgccatgtgatatgtgcttatttctccataacttgatcctagtccgtgtgatttcactattcctttttttgatgataatattggtttaataactgttgcatcaccattgactcttcctttgccttgaataggtttgattatggatgtaccttgtacttcatgatcatattgtaaagatatgaattctttactgcatatgttcattctttgtatcatctcgttcaactcaatttctaatggtttattgtgctttttagggaatattgattctgtagtttttgaccatggactagtatgtaagtggatttttggaacaccattgtgtagaaaatctacatctatatccataataacagaccctttaaatagtactactgctttattgctattattgaattctccgataatgctaatttcaatatcatgttttttcatcactttttcaaatattgagaatttattaggggaaacagcaaaggtcatcctttcttgggattctgatacccaaatctcccatggtgacatattatcgtgcttaagtaacactttatctaattctactataaaaccattattacccatttctcctatagaagaagataatcctccagctccattatcggttattgcgttgtataaatctaaatctctagcttcttttattattgcgtcagataattttttttgagtaataggatctcctatttgtactactgtactgctgctattatgttctgttaatgcgttagatgaaaaagtagcaccatgtataccatctcttccagttctgcctcctgctattactatgtaatctccgttattgggattttttacatgtgataaggatttattaattgtacgtggcataataccagtacatcctacaaacaccagtggtttactgcgaaatctattatcaaagtatgcagaccctagacttgttggtattccagaacagtttccaccataatttacaccttttattactccatccattattgtattagatgataatacttttgttgtgcaggacttgtctctgtataattcttcgtctgattcggagaagcagaaatagtaagcatttaatatcggttttgctccttttccaaatccaattatatctctatttactcctaatattccagtaattgctcctccaaaagggtcaagtgctgaaggactattgtgtgtttctactttatctgcgataatgaagttatcatcaaatactattgctcctgcattatcagaaaatgtggatacgcatatttctgagtttatttcatatgttgcacgttttatgtaatgtttatagagtccatctgtaatttcatctataggtgaggagaagatgttatgtttgcaatgctctgaccaagtttgtgctagtgtttcaagttcaatatcattaggattgcgttgaatttttttaaagtatgcttgaatggctttcattgcctctaatgataagtttaaagctccgcgaccattaattccatgtttgctgatttgaattaattcgtgatcttgaatatttagatctatggaagtaacagtaacgttttgttttttgttttgtgggaaaagatcctcatacttgacatatggtattatgaatatgctactgcatgtagaagagtcagcatatatgttgtttaggtttgatatctgtttatttccaaaaaattttactttgaatgtttttcctgttacaaaggacaatttacaatattctattaacggattgaatagctgcagaatattttcttcttgtggtattggtccttgtccgaatgttactttggacgttaatacatctgttgctgtgttatatccaagcatttcatttattatgcattttgtagtattgccaacattatcagtaactctaggtaagaaccctttttctaatgaccagtctgctttaaaggtatcgagtagattatagttagtattagtactaacatctttgtaattttgctctgtagtatcatatgtgaatgcaaaaaattgttgtgttattgaattagttagcagagaacctattttttttataattgctgtgcttaagttatgttgaacattaattgtataaactgtgacatcattacttttgtagctttttggtagtactttatctgctacgccgatgcgtataatcataagtaatttttaattaagtaatatatttacactgtataataattaggtgtaatttcaaatatattattaatatttctggtaattattcataattgcagtaggtaatagactggtcttattgtataatttatttctatctatagggatagaatagggggaaccattaaggttttgcttgcaatatgtttatcattataatgattagtgataatttcaatatttctgatagatatttaacagcttgccaggtaaaaataagccggattctgtttatgtagttattcatctgggatagatatcgctacctacctcacgcgactcacctgggtaattgtgagggaaaacacaaatacctcttcttagtcttgctcctggtggtggttacttagctactatatgttgccataagtacggtgtgctcttaccacgccttttcacccttaccttgtaacaaggcggttattttctgtagccctttacctagagtcacctccgacagggattacctgtcaccattttcccttggagtccggactttcctctgtactttacaatacagcaactacttttttacctgacaagccattataatttctaattgtattaagtaaataattaatttatatggattgaaaatatggttctctttgtttgaaagtttggataacagtttcctattatgattacaatcaatgcagaaaattaaaaaataattttttgacaaaatgttaggtttttctgctgcagataaacgtatttaattgtgtaagaagcgttaattttgtgaattgagaagtacaggttcttttgttttaattccaagcttggataataggtttttatcatcatcacaattagaattaggagttgttaataacttttctccgtagaatatagagtttgctcctgcaaataagcatagtgcttgcatttcttctgacatatcttttcttcctgcagcaagacgtacatatgattttggcattaaaatgcgagttacagctatagtcttgataaaatctatgttatctacttttatgttattttcaaaaggtgttccttttattggaactagcctattgattggtacagaacgcggatgttcctttaaatttgctaaagttaatagcatctttgctctatcttcaatactttcaccaagtcctagaataccaccagaacatatattaattcctgcttcatatatgttatttaaactagctagcctatcatcgtagttgcgtgtagtagttacattggaataaaaatcacgagatgtatcaatattatgattataaaaatctaaacctgcattttttaatttttttgcttggtccaaagttatcatgcctaaagaagcacagctctctagtttttcactttttattaggttgatgatattgcaaatatattctatatctttatctcttaattgacgccatgctgctgcgaaacaaaatctgtctgctccgctatttttggctgtttgtatagctttttttatgttttcaacatcaagtagagcttctttttgtaggtctgttttataatgtgcactttgtgaacaatatctacagttttctggacatccaccagttttgatatttaataatgcagcaagttgtatttcattgttattaaaaaactgtctatgtgttaaatgagatcgtaatattaagtcattaaatggagtattgaaaagctctaatatttcatctaattgccagttgtttcttattgtagtacatgtattcatttttgtgataactgtttttcgatttcgttttgttttgatgctatttctcttacagagctacttaaagtgtcaagttcatcttgagtaacaaaaccactatttcttaagtatgcagataaacactttttaactactctgttagtaataccaagtgtacctatagctattccaaagagcgatacactcatctttgagatatcatgtaaaaaaaatctcataaactacctgtctacaactaaatgaaacttacaaatgttttgctctcactaggtgaggaaatgctatgcaattttagtaaaacagtcaactaattttttaaatattttgataacctgcagcactgactatagattgttataagatgaatattttaatatattcttcctcctattactcctattatgtgagttacttcgttgttttcaccaataggtaataaacattgtcttatctttatgtaatttccatcagcactttcagtttctgattcatccataattggttcttgattctctacaactgattctaaataatcaaatagattctctatgacttgtggaaaaaagagcttaatgttttgggattcagcataaactttaatatttgattgatacagttccatggctctttctccaatatatatgcaattatatttttggttatctgtatcattttttacttcaatgataaagcagttaggccagatttccctgatttcttcttgttcaatttcttctatcttaggaaacattctatcattacgtaactgattccagtatgcaaatagtatttttattgctcttctttctgatacatattctgacatctataaccttgatcttgtgatgaacataaaaaacttacagtaaatgtctttattttttcttacttattctaatttttatttaattataagctgtgtatattgctctattataatatggtattttataatatttgttttggaatgaccgatagttttatgtcttctataagattgtttagcgaataaaaaatactgttttaatggaaacaaacattttttcggatataacagtattattgctggtgtatgttggcttaagtatgaaaacatggaacatgttttactcaaagaagagttatttatgtcttacaagcttcttgattacttacaattgatgtatagtaatgggttgactgcttgtccatgtttacgcatagcaaaacataagtatgatttatttttttgggaatttatacttttgatagatcctatagcttggccttgtgttactttatcacctatttttacatctatactatctaggtaagaatatgtagtaattgtgtttttgttatgctctattattatcatgttaccataccattttgatcctttgcctacgtatagtatttttccagaagatgatgctctaacctgttgtgctccattagatttgatgttaattccctctttacaatttctatcttgattgtttatagagaacttagatgttatgataccttctatgggcataataaaattgcactttttatcaatggtttttatttctttcattacttgatgattatcttgaattgtatgtgattctatgttctcgtcctttttaacatcatgtcttacaaggtgatattcattgatgtcgtctaattcttttttaccatgaaattcttctcctcgtaaaaaagaaggggcaggtttttgtgtacaaccaaaacataataagacaatcaatagtgtttttcttattgtcacatgtacctacgaatattagatattcttgttctatactattaattttatatattattctgttatatgaatttggcaatgcaaaattcatttttattagtaattaattcctgaaaataattttgtcagaacattttgatgcttttggaatgtgcttttattaagtagattgaaggaacacttacttgattgttgtagtctgtatagttatgtattaatgtaagtgtagtatgataatttgctataaatatatttatagtattatgatgtgtttgtattataacaatatggattttaataatgcaaagtttaatatttaaattattatcagttactgaagctgcagctttagcatcttataaatgtcttggtatgggtaatgaaaaagaagcagatcgtgttgctgttcatgctatgcgaaagtcattaaacttattagaaattaatgggactgttgttattggagaaggggaaagagataatgctcctatgctatatattggagaaaaagtgggtattggaggaattgatgttgacattgctcttgatccacttgaaggtactactatgtgtgctcattataaaaatggagctatgtctgttctcgcaatagcgaaaaaaggtgaatttttaaatgctcctgatgtttatatgaaaaaaattgctgtaggtcctaatgttcctaaaggtgtggtttctttaaaatatgatataaaaactaatttgtataatttagctgaggtcagaaagtgtaatgtaaatgaactgattgtaatggttttatatagagaaagacatttagaattaattaaaagtattagagaatgtggagctcgtataaagcttatagatgatggggatgtttcggctgtagtatcactgatgaaaggaactcatgatttatatgttggaactggaggagctccagagggtgtacttgcagctgctgctttgtcatcgatgggaggatacatggaaggtaaactaatttttgatacagagtatttaagagcaagagcagaacaatttggaattaaagatataaataaaatttactctatagaagaaatggtgaaatctgaatcaatttttatagctactggtattactgatagtgctttggttaaaggtattagatattcgcaagggtcttttattatagagtctataatcattaaaccggctagtgttatgtatgttaataatactgttcctgaggtatagtgggttattttaatgcttattgcaatcttatgtaaatattgtggagatgtataatagagctttgtagtgtaatttgaaaattttttataaaaagtgtgaagctgttgagtctgtaattagaaggaattatctagaatatatttatcataaaagaaagtattgtttattggtaaaattttctgaaatggtttttatatctgatacataggtatgaaacatatttcataaactaacaactggtggtgaaaatacttttatacatgttgatatgtagcttagttttgtttgttgattaagcttatgaagtctttttacttttataatgaggaattatctagatatatttatcataaaagaatgtattgtttattggtaaaaccttctgaagtggtttttggtatctgatacatgagtatgaaacatatttcataaactaataactggtggtgaaaatatttttacatgttgatatgtgcttagttttgtttgttggttaagcttatgaagtctttttacttttataatgaggaattatctagaatatatttatcataaaaaaatgtattgtttattggtaaaaccttctgaagtggttttttgtatctgatacatgagtatgaaacatatttcataaactaacaactggtggtgaaaatgcttttatacatgttgatatgtagcttagttttgtttgttggttaagcttatgaagtctttttacttttataataacgtaaatagatcaaaatattagtaattgctgctggtgttattccaggtatacgtcttgcagagccaatggaaagtggcttgatatactctagtttttcttgaatttcttttgataggccatggatttgtgaaaattctatattgtgtggaatatgtgtattttcttcttctagaaaagccttaatatctgcatcttgtctgtcaaaataaggtgcatattttgcttctattgccacttgttctgcaacatttttgttaaattcttttactgtgttgcatattcttgatacgatttccatatttatatttgggtgacctagaaggtcgaaaatactcctccttaccccatcttgagatataggtatattatgcctagcaagttgtgtaggggttgttatgatattttttaaaatatttgttaaagttattatttcctgttttttgttctttaaaatggtatatcttttggatgatacaactgatatttgatatcccagttctgttaaacgtaaatcagcattgtcggaacgtaaccttaacctatattctgctctagatgtgaaaagtctgtacggctcagatgttcctaaggtaactaaatcatctatcatcacaccaatatatgcatcacttctttttagtatgaaaggttcatactttgagttgagagataatgctgcattgattccagcaatgatcccttgccctgctgcttcttcatacccagtggtaccatttatttgtcctgcaaagtatagaccacttattttttttgtttcaagagtatgatatagttctcttggatcaataaaattgtattcaacactgtaaccacttctgattatgttgactttttctagtcctggtatggtcttcaacatttcatattgtacatcgagtggagatgaagtggtaattccattaggatagataatgttagaatctaagccttctggctctaaaaatacctgatgactattacgttctgaaaatcttcttactttttcttctattgaagggcaatatctaggagcctttatatcttttagtgaattacttgctgctgctctgtgtaaattattttttattacctcatgggttctagtattagttgcagttaaatagcatgaaatttgtggtaaatctattgattgtgacatatatgaaaaaggtgatggttcagaatcacctttttgttcttgtaatcctgaaaaatttatactgtttatgtcaagtcttggtggagtgccagtacgtaagcgacctaacttaaaattatatttttctaacgtttttgctaaaccaatggaaggttgttcaccaaatctacctgctggagtattataacttcctatgtgtatggttccttgtaaaaatgtaccagtggttagtattaatttttttgtgtatattacttgctgatcagatgtaattacagtttcgacggtgaatttttcatctttttctgttatagtaaagtcttctactgatgcttctaacactgttaaatttggatagtttagtatgatatcctgcatagtgtttttatatatttttctatctgcttgtgctcttggtccccatactgctggccctttgctcctgtttaatatactagaattaatgctagctttatctatgacttttcccattaagccatccagagcgtcaacttctctgactacagtaccttttgcaattcctccaatggctggattgcaagacatttctccaattgttgatgtagaatgtgtaatcaacagggtttttgcaccgatacgtgctgcagcagcagctgcttcacaccctgcgtggcctcctcctataactactacatcataatgatccatataagcagtataatatgttgaatactaagataatggtagtaattttattaaaattgtcaataaagttgcattctaatataaagtttttatatcataagttacttaaagatattaaataatttattgtatttttttaaattgattgcaaatagtatttttagcttaatatctaaacatattctcagaaaagaattttttataatagtgatattgctgattagatataaacattgtttagtggttttgttagcttgtattcagtatattaagtgtttttttgggttgaagaatatatagttaattatgtgtttgtttatgtaagtttattagatatgttgttgtagattaataaggttatttgttacatagaatttaaatgaatttttttagatgtagttagtagatgttatatctaaaagttgaggacttgtttacatgattttcaataaatggagtttaagtgtttactttttgtgttaagctaatagtttatatattttgatgaaaaaaatgaaggtcattgtattatctggatatggtttaaattgtgaagaagaaaccctgtttgcttttgttaaggcaggagagttattgtcatgtgatgtgcagggaaaaatagtgcatattaatgaagtaatatcatgtcctaatttgttgcgagattataatgtacttgcaattcctggaggtttttcctatggagatgatactggtgctggaaatgctttcgcattgagaatttttcataacttaagagaagaaatatcagagtttttggctggtgataaattagtaattggtatatgtaatggatgtcagatactgatgagattaatatcagattttgcgtgtataacacttttaaataattctgttcgacaatatcagtgtagatgggtgaaagtgaaagtgaatttatcaaataattcaccatggttaaaaggattaaatgaattatatattccagttgcgcatggagagggaaggttttttgtagaaaatgtctctgtcatttcttctattgagaagaatattgcgttcaggtatattaacaatgaaggtaattatgcgaatcaagaatttccttgtaatcctaatgggtcagttgccgatattgctgcactgtctgacaatagtggtaaagtattggttatgatgccacatccagagagagcaatgtttttcacacagcaggataactggacacagataaaagaacaatgtttaagatctaatattgcttatcctacttatggagatggaatgaagattttttgtaatgctgtgaaatatttttgcaaatgatctaaaaggtattttgtaagttttaatgttgttgagttttatcaggtttatcattttattacttttatgtttttggtattactgcatataaaatataaacttatataaacttttgtgggatcgataagtgcttaagatctaatattgcttatcctacttatggagatggaatgaagattttttgtaatgctgtgaaatatttttgcaaatgatctaaaaagtattttgtaagttttaatgttgttgatttttatcaggtttatcatttttatgtttttttggtattactgcatatacagtataggcttatataaacttttgtgggatcgagaaatatgtataagctacaagcagtgatatatttgttgattttagttaactatttttgatttatgaatgtgctatttagaatttcaatgtttttattgggaacattgtagaatgtagtcaaaatttattgtattttgagatcaggattgtgtaagaaatattgtgtaaggaatgtagtgatggtgaattgttattgtacgatatgtaattattataataggttatgggttttaaagctgtagtgggcattagatgtaactatgacatgatctattagtgttattccgacatcactgcatgctctggcaagttgattagtaatttcaatatctgctttagaaggcttagcatctccactgggatggttgtgggcaataataatggatgtagcttctaaaaatagagatttttttattatttctcttacatatagaggagtttggtttacagtgcctacatcttgagtttcatctgcaaggagtttgtattttgtatttaaatataatatatgaaagttttctacactgccattacctatctttatcctaagatattctattaacttttgccattgattaataattgtgcctttatcaatattttcacgtagaattctgtttaatgcttctctaatacaaaaaattgctgatattgcaacttctcctataccggatatttgcttgagttgactgtaatcagcaaaaaaaacttttgcaaaagttccaaaatgttcaattagctttttagcaataggttttacatcttttcttggatgtgcagaacatagaattaattctaaaatttcataatctagtaaccctttgtttcctttagatagtaatttttgtcttagcctttttctatgtccaatttgttgtttttggcgttcatctttgatattcattaacttacttaaaaaattaactacttaaatatcaacgatgttttcagtatcaagtcaattgattttttatgtgttatgtaaactgttacagagtaatataatatttctactgggtcctataaagttctaaccttgtaaacatttgtgcaatatgtattataaaatttattgattgatacttgaaattagatttcttgatattatatatgatcttagctagtagtatctgatgctactgataatttatttttttatagaggtagtgtatgaatctaaatatgttacatgataatgtgttgattgaggctttggaggagtgtaatagtagttctcctatacagcttcctgattcagctaagaaaaaacctactcaaggtaaagttgtggctgttgggccaggtgtatacaatcatagtggcaatattcttcctatgactattaaagtaggagatgtagttttttatcgtcagtgggctggtaatgaaattgaattccacgataaaaaatacatagttatgaaagaaagtgatatcattgcaaaagaagcatagtcattacattgagtttaaatatgctatacatgtgtttttttgtaatagcctaagtataagtagttttaattaattttttattaaacggagattaaataacatggcaaatgtagttgtgactggtgaacaacttgataaatcaattagagaagttgttcgtattttagaagatgctgtaggatgtacggctgggcctaagggacttactgtagctattggtaaatcttatggagctccagaagttacaaaagatggatataaagttattaagagtataaagccagaggatccattggctcttgctattgctaatataattactcagagtgcttctcaatgtaatgataaagttggtgatggaacaactacatgttctattttaactgcaaaagttatagaagaagtatctaaagctaaagctgctggagcagatattgtgtgtattaaagaaggtgtactaaaagctaaagaggctgttttggaagcattaatgtctatgaagcgtgaagtgttgtctgaagaagaaattgcacaagttgctactatttcagctaatggagataagaatataggtagtaagattgcacaatgtgttcaagaagttggtaaagatggggttattacagttgaagaaagtaaaggctttaaagaattagatgttgaaaaaactgatggtatgcagtttgatcgtggatacctttctccttattttgtaactaattcagaaaagatgttagtggaatttgaaaatccttatatcttactaacagagaaaaaacttaatatcatacaacctatattaccaattttggaaaatgtggctagatcaggaagacctcttttaattattgcagaagatgtggaaggtgaagcacttagcactctcgttttaaataaattgcgcggtgggttacatgtagcagcagttaaagcgccagggtttggtgatagaagaaaagatatgttaggtgatattgctattttaactggagctaaacatgtaataagtgatgatcttgcaataaaaatggaagatctaactttagctgaattaggtactgctaaaaatatacgtattacaaaagatactactactattatcggtagtgtagataatagttctgctaatgtacaaagtagaattaatcaaattaaaatgcaaattgaagcttctacatcagattatgacaaagaaaaattaagagagcgtttagctaagctatcaggtggtgttgctgtattgaaagttggtgggtctagtgaagttgaagttaaagaacgtaaagaccgtgttgaagatgctttacacgcaactagagctgctgttgaagaaggtgttgtaccaggaggtggtgctgcattattatatacattatcagttcttgaaaacttgaagagtaaaaatgatgatgaacaattaggtattaatattgtaaaacgcgctttacaagctcctattaaacgtatcattaaaaactctggatcagaaaatgctccatgtgttattgctcatttgttaaaacaaaatgataaagagcttatttttaatgttgatacaatgaattttgcaaatgcttttacttctggggttattgatccactgaaggtagtgcgtatagcatttgattttgctgtatctcttgcagcagtatttatgactctaaatgctattgtagtagatgtaccatctaaagatgatgctaatgctggtgctggaggcatgggaggcatgggaggtatgggaggattctaattaatagataatcttctatattgactaatggggtaaagtcttttaagactttgcccccttcttttagtttatgtttttcaaatatattgcctatgtaataacaaaaagactgctatagtttattatatgttgtgtcaaatatgtaaaatgttttggctattctttatttttataatgtcgttaaacttattgttctataattgtatttgttctctatttagcgttgcataaagtataaacattttgcttgcgcctaatctgtggtagtggcttgctttttgattatatgttagttaataaacattattcggtaaaagtatagtgtgatattattataagcttttcagatttgtactatgtgtaatataagtgattagcatagttatacaaaatatatggtaacagtctgtttctgttcctgtaaaagaaaaatatgatcgtttaccttagtttagcataagaacttatttaataagagattgattgacatgttgaaaatctgtcttgattgttatgaaataaagtatagtagggttaatttactaaagcgaaccagaattaatattatctttaatctattctatattgtaaaataagattgttatatatatgcttgattgtattgtacagaatgctaattttgctaggaaaaagagctagcattcatcttctgatcctattttataaatctgtcctgtaacattgcattgattagatgatagttcaatgaatttgtcagtaaaattttctggaaggactgattgtgcagtttcttttattggtagtgcttgagcgtatatatcattgtccattagtgatggatataccatgttaacacataatttgctatgctttgtttctgtagcatatattcttagcattgtttctaaagcagctttgcttgatgcatatgtgctccaatatggatatctagatggtgattgtgtgacctcagaagtaacagcaattaccctaccagctggggaaagtttaagtaatggatcaaagtattttattaaatgccagttagctataaaatttatatccattatccttttccatgtatcatattcataatcttgtgtagggctaagatctcctaccactgctgcgtttaatattaatatatctatatttttaaacttattgcctatagacattgcaaaattttttattgtatcgaaatcctgaagatcaactgctgctaacattgcatcacctcctaactcttttatagagtcatatacagcatttaatttattaatattcttagctactaagataaggcaagctccttctttagcaaatctttttgcaacagctgaacctatgcttccagaagcacctgtaattattgctactttacctgctaattgtttttccatacagtaccctatcatcttttgatattcagatgataagcagtatcaattaagttggcaagcaaaacagtagaacgtgtaaattgtagatattcaatttactgctagtagagaatttagttaatgtttgattatgatagatattctataaaaatgttaatatattattgttattagttatatgtattacttacattaagatgatggatttattataagatacttatactatctgtattggcatatagttattaataaaaaaatatcttagtaataaaattataaaaacacctttaatttttataaataatgtttatatgtaagttagatcatttaggtgaggctagttatggatctcaatcaatttactgatatgtcaaagaatttaataatgcaggcgcaaactacagcaattgcatcagggcatcaatctttgataccagagcatttacttaaagtaatgttagatactaaagatgagcttattgagctgttgctgacttcatgtggatgtgatattgataagatatacagtgatataaaactctccttaagtaaattacctgttgtaagtggaagtggtagtggtcatatacatttatcaaaagaaatggctcaggttttagaagaagctattagtttagcaaaaaggaatcaggatacttatgtaactgtggagagattattacaagctcttgcagttgttaaagacactagtgtttacaagatactacttgcacatggagtaactcctgttaagttagaatcactaatacttaatatgcgtaatggatctaaggctgatactattaatgctgaacataaatttaatgctctgaaaaaatatgctaaagatattacagaatctgccatggctgggaaacttgatccagttattggaagagatgaagagattagacgtacaatgcaagttttatcacgcagaacaaagaataatcctgtattaattggagaacctggagttggtaagacagcaattattgaaggattggcacagcgtattgtggtaggtgatgttcctgttggactaagaaatgcaaaaataatggcactggatcttggaatgcttgttgctggaacaaaatatagaggggaatttgaggaaagattaaaatatgtaattaatgaaatagtggcgtcaaatggtgcggttatattgtttattgatgaattacacacattagttggagctggtgctacagatggtgcaatggatgcatcgaacttgttaaaacctgctttagcaaggggtgaaatacattgtataggagcaacaacattggatgaatataggcaacacatagaaaaagatgctgcattggctagaaggtttcaacctgtgtttgtttctgaatctactgttaatgatactatctctattttgcgtggattgaaagaaaaatatgaagtacaccatggtattaggattatggatagtgcgattattgctgcttcaactttgtcaaatcgttatattacagataggtttttaccagataaagctatagatctaattgatgaagcagcaagtcgtgtaagaatagagattgatagtaaacctgaggtaattgacgaattagatagaaaaattattcaattgaagattgaggctggagttttagaaaaagaaaatactgaatcttcaaaacagcgtttagcccaattaagtgaagaattgaataaattaagtattcaagcaacagaattaaatagtaagtggcaggctgagaaaatgaagatattaaaaatgcaagaatgtgtggaaaagttagataatgcaagaaatgatttagaaaaagctcaaaggtctggtaatttggcaaaagctggcgaattgatgtatggaattatcccagaacttgaaaaagagttaaaaaaatgtgaaaaacctagtagtaacatgttgaaaagggaagtgactgaaagtgatatagcaagtattgtatcacggtggacaggtattcctattgaaaacatgatgagcagtgaaaaagaaaaattgctgcgtatggaagaagagatagggaaaacagtcattggtcaagaaagtgctattaaagcagtaagtgatgctgttagaagatcgcgtgcaggagtacaagatgccaataaaccattaggatcttttttattccttggacctactggagtaggaaaaacagaattagtaaaaacattagctgaatttttattttgtgataaatctgctttattgaggtttgatatgtctgagtttatggaaaagcatgctgtatctcggttaataggtgctcctccaggatatgtaggatatgatcaaggtggtatgttgactgaatctgtgaggaggagaccttatcaagttatactttttgatgaaatagagaaagcacatggagatatttttaatattttattgcaagtattagatgagggacggttaactgataaccatggtaaattggttgattttcgtaatacaatactggttttaacatcaaacttaggacaagaaatactgattaataataaggaagatgttgatggagagtcagtaaaaaaatctataactagtgtgttacaacatcattttcggccagaatttttaaacagattagatgaaattattgtatttcatagattaactaaggaacatatagagaaaattatagatgtacaattttctctgttacagaaaattgttgctcaaaaagagttagagattagtttatcttcggaggcaaaatcttggttgatgaataatggctatgattcgttatatggggcaagacctttgaaaagattaatacaacaaaaaatacaaaatagtttagcaaagttaatacttgcaaatcaagttagtaagggagataagctagaagtagttttgttgaatgacgatttaattattaataagttatagattaataataatattatcatatggaatttgctgaaagtatattgagtttcatttgtacaatagtgaaatgcttattgacctttgtagtagtgcataatagttattattaagacatacggataacaacttttgtgattatttataagacttatacggatttttatcctcaattgtaatgttaaagtaataagtttttatcccaagtgtatttttggtgtatcgtgctactagtaagtcttgtaaattgaagtctatgttttgaaattgattatcaattgaattgtcatattctgggaaaaacattgttgtattaaattcagaaaattctgaatgttgtaacaaaaaatgtatacgaggaactttgtttttcttgttaataccagggataatggttataaaactataatttcctaaattgtcagttactgattttcctgaaccaatgaactgataatcatacatatctaattcttctagaataagttctgatttgtgtttatcgtcttggctgtcttgatatattccatgtgcattggtgtgccagataaagacgttagcatttgctataggtatacaatttgtgttagtgactttgccgacaatatatatcagttctccatcagctgctaatgggctgctcatcttgcgtcgtaaattgtttgataaagaaaacttacttggtttattgttaaggtcaaagatttcaggagttttttggcagtgaacgagaattggatcaattgccaatgcatcgtatgtacatgttatacttatgagtaagcataacaatgattttgctaagtagttcatcttattaccataatttaaatctttaagtcataaacaagataactttttattatgatttaacttaatcttacgtagagatcatattacccataatagtttcttgttatagcatattataaatactaaatattgtaattcctaaaaaaacttttttgtgtgactatttgtaaactagattgtagtctatttaaagatatatttataatttttttgaatttgtataggtcatatttctattctgtatgagtcatattgtaaaaatatatggttttcatgataaatacaatatttaattctataaaattttattaaataattaattattattcacttaattttacttgaaaagtttctaaaaagagttaaagtaaaaattacatgtaaatgccaatttaggataaccatatgatagatatatcgttttcaagtttaatgccaggggtatctttgtttttaaagacaacagcaatagttgtgggtatctttgaaggtagtaatcacttggaagactatagtgccttagctgagcgtagtgagcaaattatgaaggtggtagaaggttacaagtcttttgatggtaagtttgcagaagtattgccaattactggattagatgcagggtatcctatagtaatagtagtagggttgggtaaacctgaagagtttgatgaaaacaaatctttaaggattggtggtgttatatattctgaacttaataggatgaaaatatcagaggcctcaattataagtagtaatgatagtgatattatggctaatgttgcctatggggcatttttacgcagttttaagtttgataaatattttgttcagaaaaaagatgaaaatgcaacttatgtgcgtaagttagagttcttttcaaaaactaatcctcaaaaaacagctgttttgtttgataatttaaaagccgaaggtgagtcagtatttttagctcgttcttttgtttcagaacctcctaatattctttatccagaaatttatgctcagatgatatatgaggaattaagtaaagtagatgttaaagttgaaatatttgatgaagattatatgaaagcaaatcagatgatggcacttctaggtgtaggacaaggtagtgctaagaaatctaggcttgtggttatgaggtggaatggaggaaaagaaacagacagtccgatagcatttgttggaaaaggagtgacgtttgatactggtggaatatctttaaaaccttctaggggtatgtgggatatgaaatatgatatggctggttctgcgtctgttgtaggtattatgcggactcttgcagcaagaaaagcaaaagttaatgctgtaggtgtagtagggttagttgaaaatgctgtaggaggaaatgcgcaaagaccaagtgatgttgtaacttcaatgtctgggcaaactattgaagtattgaatactgatgcagaaggtagactagttttggctgatgctttatggtatactcagaaaatgttttctccaaaattaatgatagatttagcaacattaactggtgcagtggttgtagcactaggaaataatcaatatggtgggattttttcaaacgatgatgcaattgccaatcaattaattgttgctggtaatgagtccggtgagaaattgtggagattacctttagatgatgcatatgataaacttatagattcttcgattgctgatgtgcaaaatatttcaacaaaagggtatggtgcagatagcattactgctgcacaatttttacagagatttgtaaataagactccttgggtgcatctggatattgctggaatggcgtgggataatgaaggtaatgaaatatgccctaaaggtgcaactgggtttggtgtaaggttactgaataggttgattttaaaatactatgaggctaattaaactattgtaatagtgttttgttaacaaatttatatagttatgattttataaagattctggagtactagtcaatttgggatataatatgatttattttacgatgctctttgtacatggttaatattatgggtaacttagttatatgacgccgcttaagttaggtattttaatttcaggaaggggttctaatatgcaagcattaattaatgcttgtgcacaggatgatttccctgcagaagtatcctgtgtgatttctaataaccctaaagcaaatggtttattgattgcacaaaaacaaaatattaagacttttgtagtacaaggtcgtccattggattttgattctattgatagtatacttagacaacatcaagtagatttaatatgccttgcagggtttatgagtattgtacctgagggctttattaataagtggtttcataaaattattaatatacatccttctcttttaccgtcttttaaaggattgaatgcacagtctcaagcattgaaagctggagttaaaattgcaggatgtactgtgcattatgtatatccagaagttgatggtggtcccattatcgtacaagcagcagttcctgttttttcatcggataatcttacagatctttccgagaggatattaaaaatggaacatatttgttatcctaaagctgtaaagttgattgcattgaatcagcttcaacttaatgaaaatttagccacatcagcggaattgttgcatatgttttatgatgaaactatttaattcttttatatgttacgtaaaatctgagtaaaaaatttgtttttatgtattctagtaagcttgtaaattatatatacgtgtggtaatacttttaagttatctgaaatttagtaagaatttttatttttgttagttctgaattttaatagaaaatttttaattgatttagcttactacatctgcatttttgtcgaagttatataatagttttggtctattattgagtgtatagtgttatgatgatttttttgatgtgtgattaagtctatgtcatatgatttaatagagtggaaaatagagtctctacaaatagattatcaagaggcaatatgctttatgcaacaaaggatagaggatatttataatggagtgcaaaaggaattagtttggttgcttgaacatcctccgttgtatactgctggtactggagctaaagttgaagatttactagttgataatttatttcctgtatatgctacaaatagaggtggtaaatatacttatcatggccctgggcaaaggattgcttatgttatgttgaatctgaaaaccagaaacaagtgtaatattagattatatgttgagactttaggcaattggattgttgaaactttaagtcatttttcagtcaagtcgtattttaatcctgacttgataggtgtatgggtaactcatggtggtactgaaaaaaaaattgctgcatttggaattaggataaggaagtgggtaacttatcatggagtatctataaatattgatacaaatctttctcattattcaggcatagtaccatgtggtattaaagattatggtattacttctcttaggaagttgggaattaatatctcttatgaagaatttgatattgtactacaagaaaagtttaatgaaattttttctaattttaattgaaagaacactgtaatatgttgaaattaagtggcatatactcttctatcttgtaatagcagcatttttaatgcaatcaatgtaaatttggagttggtaaatgctgaaaaatattttcatattggtgtagttacgttgggtgtgatgggccttttgtattgaaagtattatataaaaatttataactctgtataagttgatgatcatgtttaatatggggaatgattgaataagtggtgatagtgtttattaatgagtatttatgttgtgaatttgcttggtgagagtttttattagtactatatggaattctgtgaaaatttgttactttatgtaagctagtataatttttttaacgtaaaaagtaatgaaaagggtagtactaatttttacttataaatgctttaatattacaaattaacttgaaaatccttatgatttatgaaaacttatcacttgtgtaagttgataatcatattagtttaataagaataataaatacctgagtaagaagtattttagattatgatttctgctttgtaagtagttttgccagatactatagtccttaaaactttaccttttactttacggttgtgaaagggggaattttttgatttacttgcaaattttgatatgtcaactacccattcatgatctaaatccaatatgatgagatctgcaacatagtctttttttatacgccctcttggtacctttataatatcagctggcttgtatgttaatgttgctagtagatctattaaaggcatggtaccattatgatataattctaaagaaattggaagcattgtttctaatccaactattccaaaagcagctgtatctaatggtaattccttagcattgatatcatgaggagcatgatctgttgctatacaatctattatgccactttttaatccttctatcatactaaggcgatcattttcagttcgcaaaggaggattcatttttgcaagactaccatgtgtcattatgtctctttcagttaaagtgaaatgatgaggagttacttcacaagtaacttttagtccttgactttttgcttgttttattatgtgtaaagactcttgggatgagacatgtaaaatgtgataatgtacatttttgatatttttcattaaagcaatatcacgatttactattatagattctgaaatatcaggtataccttttaatcctaattcatatgatattattccttcattgatacatccgttattagatatgtttaggtcttctgcgtgttgtgctataacggtatccaacatacttgagtaacttagtgcttgtctcattgttaaagcgttcattactggcatgccatcatcagtaaaaccaactgctcctacttcttttaacagtgccatatcggataatgaattatctgattttgttatagaagcataaaactctatgttgacataagcactttctagagctctcattttaatgtattttgcagtgattacactactgatagtagggatagtattgggttggcaaactacagttgttatacctccagctgcagcagatttgcttcctgtattgatggtttctttatgctcttggcctggttctcggaaatgcacatgaatatcaattaaacctggtaacagtatgttattattgcaatctatgacctcatctatagtacttggtataccattagcaaatagatcaggtccaaaatcaataatcttatctcctttggtaagtagcgaacctctgatatctaacttagattctgggtcaatgattcttgcattaatatatgcaacggttaaatctgcatgttgcccattgcctaacaattcccaagattgtttatacatttttcaaatgcctaagaaagtatgaataaatgagtaactgatataaatacatctattataacactatctgtaaattgttttatagtcaatatttatgtataacatgtatagtattaaaaatcatatatacattcttttatgttattttatagttataatgcaatgttgatatttttttaaagctttgagttttaataaatcctttttgtatttactagttgtaatttgaaatttttttgaattgctagattatgatttagtattatttatcttagctaaaaaatttataatttcttctgtaattaattgacctatttcttttttagacattatagggaattctttataatgatctttagtaatgatagtaattttattatagtcatttcccataacgtgttcattgttaatggttgttgtattgctgataatccaatcgcattgttttcttttaagtttaatttttgcattttctatgacattttctgactctaatgagaatccaatgactagttttggcctcttttcatgagtacttatacaatgaataatatctgggttgttagtaactttaatatttgtaatttcatgtttttttatttttctgacagaatatgtagggcaccaatcagtaactgctgcagtgaaaattgcaatatctactggcagtaactctatgcaggtttgtagcatttcattgcagttttttacatgtaatatattttgtatattatgattatgaattgtaactggcccagatactaggtttactttccaaccaattttattcatatattctgctattgcgtacccttgttttccagatgcattattagagatatatctgataggatcgattgcttcttgtgttggtccagctgttattaatacattaaccataaagtattgaaatatttaaatttttattctagtacaaaattacagtaattcacaataatttcttcaacaactatgtatgcatatttactagattaactgttacaaacaacctgattgtacagttaatcctagaagaatatggaattgctgttgcggtagtataattgttgtgtactgggatattcattatatgcaattgtaaagttcaaatatttttaagtgattgtacatgttctatttttgagtgtgctgttatatgtttggttggacaattcgatttgtactgccttggttattattgatgttatgaaatgttagatagaattgatatgtaaaagtcttgtgatgcttatatagtgtagcactaatatagttgtgttagttatggtggacataaatacaaaactttattaatataatttatcacatgtaggtggaaaatttagaatatgagaaaggaaagagatagtttgggagagatagatgttcctgcatgccattactggggtgcacaaacacaacgttctattgataattttaagattggctcagagaaaatgcctaaacctttaataaaggcattaggacttgttaaattagctgcagctcgtgtcaatatgaaaaatggtgatattagtgaaacaataggtaatgcaatttgtaatgctgcaagtgaaattatagatggtaagtttgatgatgagttccctttagtaatttggcaaactggttctgggactcaaagtaatatgaatgttaatgaagtaatagcaaatcgtgcaattgaaatattaggtggagaaaaaggtagtaaatatcctgtccatccaaatgatcatgtgaattattctcaatcctctaatgatacttttccaacagcaatgcatattgcggctgttattgaaactgaaaattcattgttgccaaatttgaaaaatttatatgatgctctacatagtaagtctatagcgtttcaaaatattgttaaaattgggcgtactcaccttcaagatgctactccgttgactttagggcaggtattttctgggtatgcgtatcagattttacagggtatgagtagggtcaagtcagcgttaggtcatttacttgagctagctcaaggtggtactgcagtaggtactggtattaattctaggaaacagtttgatgtccattttgcaagtgaaataaaaaaattaacaggttttaattttgttgcttctgttaataaatttgaggcattagctacacatgatgcattggttgaatttagtggagctttaaatgtgcttgcagtaagtttaatgaaaatagctaatgatattaggttacttagttcaggtccaagatgtggaataggggaaattatattgcctactaatgaacctggatcttctataatgcctgggaaagtaaatcctacccagtgtgaagctgttactatggtgtgtgctcaagttatggggaatcatacaactgttactgttgcagggtcaaatggtcattttgagttgaatgtatttaaaccagtgattatttataatgttttacaatctattagattattgtctgacgttagcattaatttttctcacaagtgcgttcaggggataaaagctgatacaaatcgtatttcgtttttgttgagtcaatctttaatgttggtaacagcattaaacaaacatataggttatgataatgcggcaaaaattgcaaagactgcctttgatgagggaataacgttaaaaaatgctgcagttaagttgaatttaataagtgaagaggagtttgataaaatcgttaatccagaaaatatgatatatcctacaggttaaatattgtttaatacaacttgtttaataactaacagtgttgacagttaatacgtgttattataacatgaagtattatgttcttaatgaaaagtgattttatggcagaagacgattacaaaggtgtgataaagcaatatatagatacagtaaaagagattgtgggtgatagcaaaacctttgatcagatgtttgaatcggttgtaagaattcaagaaagagttatggcggcgaatgctcaaaataacgaggatggtgtcattgataatggagaccaggtaaaacgtataggatcttctacttctgaatctattagcaatactgagtataaggagctaatggaggaacttaaggtaattaaaaaacgtattttaagattagaacgtaaaatattaaaacctaaagaagaagtataagatttattgtagtatatgttttatatttttttttggtagttatttataggggttctttattacaataacctggtttttttattggtagctgtagtaaggggagagtaagttattcttgtgttattaagcagggtttttcagttgtttatttaatatttgttcctgtatgaaggctatcctttgttgattacctattaattgaaattatgtatagtcattgttactaagttataagtaattgagtggctttatgtagtattatcctaaagttggggaagtctacatatttgttaatgttcctgtagttttatatttataacaaagaagtaaatatatttatatctaatcttatttaattttacaatataagtttttaattcattgtatgtggccgtactgtcgatatttttataaagtatgaaatttgttgctcttttgatagtcggtgatattctgacaactcgttatttttttgtgtattcctgcatagattctacgtgaataccttgcttttttaatgtttttattgcaagtgctaaagctcttgcaccaggtattgtggtactatatggaattttttttatcagtgcagtttttcttatgctactactttctgaaaaggacttgataccttctgaagtattaattactagatttattttatcatcttgtaataagtctaatatatgtggtctaccttctcttactttatttacatgttctgtagtaatacctgcttcatttaaataagtggatgtgcctttagtcgagaatatagtaaaaccgatatcttttaatatttgtgctgttttcacaatgagtggtttatctgaatttttaacagatataaaggctgtacctttagttggtaattcgtaaccagcagccatttgtgcttttgcgaatgctatttcaaatgatttatcgattcccattacttctcctgtagacttcatttcaggtcctaataaaacatctatgtttggaaatcttgagaaagaaaatactgcttcctttacagctacatgtgtgagtttctcttcaagagcgttaggaagttttttacctagtaatacttctgttgcaatttttgctatagggatacctgtagcttttgcaataaaaggtacagttctgctagctctagggttaacttctaatatgtatatttcgccatcttgtattgcatattgtatattaataaatcctctgacttgtagtgcaagtgctattttttttgtctgctctgctatagcatctgttatttctgaggttaaactatatgaaggtaaagaacatgcagaatctcctgagtgtacaccagcttcttctatgtgctccattatccctgctatatataccttttctccatcacagatagcgtctacatctacttcaattgcatgagttaaaaattgatctaacaataatgatccatgatcgaatatgttcttataagtagttaagtaatttgataaagcattactatcacgaataattgacattgattgtccacctagtacgtacgatggtcttgctagtatagggaatactaaatctttgatgcattcatatacttcatgtattgaattgcaagtgatattagaaggttgctttaaatttaattgtgtaagcaattgttgaaatttcatgcgatcttcagctaaatctatggaatcaaaggatgttccaagaatattaatgtttttctcttgtaatacttttgcaagctttaaaggtgtttgtccaccaaattgtactattactcctaataaagagtttgtctcttgttctttatatatgatgtctagaacactttctcgtgttagaggagaaaaatataatttatctgaaatgtcgtaatcagttgaaacggtttccggattacaatttatcataatagactcataccccatttgtcttatggtatgtgctgcatgtacacatgtataatcaaattctataccttgaccaatacggttaggaccactgcctaaaattatcacttttttgttatttgttacaacagactcacattcagtgacattgatagtattaccttcatagcaactatacatatatgatgcattggttttaaattctcctgcacaagtatctatatgtttatatacaggttttatggataaagatttcctcagatcttctatatattctactgtagtcttgcttaaatatgctaaccttatatcagaaaaccccattttctttagtaataacaacccttctgcttcttttggtaatccatttttctgtatttgttgttcacattgtataatatttttgatttgggttaaaaaccaaggatcgtacccagtaattttattgatttcttctatgctaatattgtgtcgtaaagcatctgcaattataaatattctatctggagataattttacaagggagttatatagttggtctatttctatgttttggtcgaaatactcgtttaatccagaatatccagcttctaaggaacacagtgctttttgtaatgattctggaaaagatcttccaattgccattacttctcctacagatttcatggaggttgacagttctttttctgtacctcggaacttatcaaaattgaatcgtggaatttttgtaacaatgtaatctatgcttggttcaaatgatgctggaatgacttctgtacagtcattttgtatctcatctagagaataaccaatagctaattttgcggcaaccttagctataggataacctgttgcttttgatgctagtgctgatgatctagagactcttgggttcatctctataacgagtaaatcattgtcattttttgggtttactgcaaactgtacgtttgatccaccagtatctactcctatttctctaagtatagaaaatgatatgtctcgcattttttgatattctacatctcttaaagtcaatgcaggtgctactgttatactatctccagtgtgtactcccattggatcgagattttctatagaacaaactacaatgcagttatctttattatctcgcataacttccatttcaaattctttccacccgatgatggattcatctacttgtacctcagatattggggaaatgtttaaaccatggcttacatttttatgaaactcttctttattataggatataccaccccctatgccaccaagagtaaatgatggcctaattattgctggtaatcctatgtattctaatgcgtcatttatttcatcaacacttcttattattatactttttggatattttactcctattttgtccattgcttgtcggaatagattcctatcttcagcttttttaattgcttcttttgttgcacctattagttttacgttatatttttctaagattcctaactcacataggttgattgcagcgtttagagcagtttgcccacctactgttggtagtattgcgcttggtctttcttttataatgattttttcaataatgtttgatgtaattggttcaatgtatgttgaatcagcaatttcgggatcagtcattattgttgcagggtttgagttaatgaggataattcgatatccttcttgttttaaaactttacaagcttgtgtacctgaataatcaaattcacatgcttgtcctataactataggacctgctccaataactaatattgattctatgtctgtacgttttggcatgatgtatataaagaatttagctgttaatactataactattaatgcttcgtcttcaaaataaaaaaagtaaaaactaatgtttgataaggagttttacttatttttatatgatgtaaaatgagaatcattgataagcattaaactataatcggtactgcaattttcattatttatatgagtgctatgatactcaaagctttttcaaaataaaaaaagtcacaactaatatttaataaggaattttgcctatttttatataatgttaaatgacaatcattggtaagccttaaactataacagtactgcaatttttactgtttataaaggtgtcatgatgcttaaaactttaatggtacaagatattttatacctgctgtactgagtatgttcttggtatactgttgatatgaaatgtattattgaaagtagtaaattcttgattaggatgagaagtactatgattgtaaattggtgttatgtttatctctttttatgaggaaagtatagctaatgttataaatgaatagaatatattgaaaagctatgcttagtatgtgaatgttttgtacggtaggtatgaatttaatataatatgttttttagcatcctttgtgttaaaagtaatattgtcattttataacttcctgattattactgtattttttcagaatatgactagtgtaatattttaagttctcatattattaatacaatattaaatactaaattaaatatattaaaaaattattacaaataattaagaattagtaaactttatatgtttatgacatttatagaaaatgttatttttacaactcttagttgtatagtataaaaattattatactatactaatttaataataaataggtaagtaagatggctatgataataaagtttggggttgaaaatctgatcgatagtgctgtggaaatagtttgtaaatattttgatatatatcagcgaaatgatgcagtaaaacatgtattacataaatgtattaaaagtttaagaactgtagaaaagaaattaaagatatatagagggaaagaagctaaaggacatgtaattagtgatagccaatttgctgaaatggaggatctaataaaaaaagttctcatgaaggtgtttgagattgatatttcttatcaaaaacaacacttgtctgcagaaaaaatggaggagtataaagtagctgttagtcttttattggatcaaatagtaaggtgtaagtcttatgctcttaaagaaagtgatattcttcctaaggttgtagggaatgcaaccttaaaacgtagtgcatataagtgtaagcatgtagtggattttattaataagaatagatttcttcctatgaatatggggagatttgataagctttgttttgatctagatttagatcctcagattttgaaacaagttatagatttatgcagttttgctcttatatttgaaattttggatcttaagttagtacaatttcttgttgaaatgagattctttccacatcaaaacactaatgtaattagtataactaaagataattacatagaattaatgcagcatattatgctttataaatgttctcagtctattggcaaagagtatactaatgagcaagcaaggtacttaccttgtttttcacctggttatactcggggtaatgttaagggcaattcattcatatgtttaggaatagctttgtttatagcacaagctctatttaatggatttgggttattatttatgttgctgtctgaatttaagacacaaaatgattggtggtttattggcatatgtgttgttaatatgctcttagccgttactgctcttacgttgatttgtattggaaagaaacaactgagtcaaaatcatgataccttattaacggatatagatgtcagtggtattaatattgttgaagaaagtgtagatttatagttttttatttgtatgtcatttgtattagatatagctgataaaaatgcaatttatattgtaacatgattattaagtttgatgatttattttattataacaacaagttatatgtctgtatgtctttcattttatatttctctgattatataatatcaaccagttaacaatgtgctctgtatcaattgcttgtcgatatgtttataaaatatcagagtgctttttttctattactgcaagcaatcgttgtgtaggtttttataagtctacttttgatgttattttacttaacttattatggaaatttctgttgtctataaagaatcatgtatgtctttttacttctttgtttaattctaaatgattttattatgtattgaacattatgtgttcttaaatctatattcttaaataaatgtgttatcaatatagcatatattatcagtagatttattgtattatcaaatagaaagcttaattatagaatttttaaatttaaatattatttaggtgtgtttgatgcatttttctaagtaagttgaatgcttcgctatgtaagtgagtgttatgtaccctaataaagtctataccttgttgaaatagaaagattgatattgctagtgtagcattgtcacgtgttggatcatttgatgtgtatgaagtaagaaagaattttcgtgagtgtccaacatatattttttgatttaaaacttttaatctatcgatattgtttaatatataaaatgtttgattggcggttttactaaatcctatacctggatcaataatgattctgtttttatcaattcctgcatttgttagtttatcaatgtacttctttgcccatataataatttcattaattggatcaaggttttttggaatagtattgtttttaattaatggtatacctagactatgggtaattacaacatttacagaactattttgtagcacctgaagcatgttcttgtctgataatgtacttacatcgtttacataatctacatttaattctatagctttttcagcagtttttgcatatctagtgtctatgctgacttgaacattatgattatgagctatttctattattttaggcagtatatactttaatctatcccattcttctgtttgagatattgtattgttcccatgttgtgtatataggtatgtaggccttgttgattctcctcctacatctattatatctgctccaccgttgattaagtgcttaacttgttgtaatgctttatctatactgaaaaattgcccgccatctgaaaatgagtcaggagtataatttaatatgccaactagtttcgtattgaatttcatgagatctatctgaaaaataatgctatgagtattaatgatataaattgcaatagtactctaattatcattattttatttctatgtttaatgtagaattcattacttatcgccattaacactactccagatatcaaagatattagtgttaatgacacgaaaactgaaattactattaacgatgttgtattactaaacatttttacacaatataaaaatacactgcattatatcataatagtataactttatctcagtaaaaaattatttatgtgaaaatttattaaatatctgtattgtttgcttagatgaacgtattgtaatatgtgtataatatattaattatttagagggatatgtggaaggagtaaattttaactttcaaacaatgaaggaactgaaacagagtgttttgtacacaagtttagaaaagtgtaaaagtgtcttttggtttattttctggtttagttctgctattaatttgcttatgttgtttttaccactatatacttctcaggtattagatagagtactttcaagtggtagtgtttctaccttaattatgttaagtgttattactgttggtgcttttgcttgttcttctatattggaaatttgtagatctttagttatggctaaagttggtgattggatagataaggttgttacccctgatcttattatgaaatctattagcttaacttcggtgaagtcatctacttcaagtggggaagtacttcgtgatttagctgttgttaaaaactttattactggatttggtatattttcactgtttgatactccatgggcggtgttatatctagttactatttttatgatacacagtgtgacaggttatattgctgtggtaggaatagtgttattaactggtatggctatttggaatgaattagcaacaaaaaagatattgcaagaagcgagtgaggaaggggtacgtaatattcactcaatagatgttgcaactcgtaatgctgaagtagttgaagcgatgggaatggttaactatattgtggatgattgggcagataggaatgatagaaatagagagatgcaaataaaagcacaaaatcgttcaaatttaatttctgggattactaaatttattagatcaatattacaaatatcagttataggtattggaggatttcttgcaattcttggtcataaaactgctgggggtattattgcttcatcaatcttaatgggaagagcattagctccatttgaagcattgattaatacttggaaaatgttaatatcagctcgcatatcttataaaagattgcagatattacttttagcttctccgaagagagaacagagcatgtctttaccagctccttctggaagggttgtatttgatcgtgtcttctttactccttatggtagcaataaaccgactattaagggtgtatctttttcaatggaggttggggatatcgttggtgttatagggcatagtgcgtctgggaagtccacaatagcaaagttattggtaggagtatggaaaccgatatcaggtgttgttagacttgatggtgcagatgtttatacgtggaatagagaagattttggacgttatattggttaccttccacaagatgttgagttgtttaatgcttcggtaaaagttaatattgcaaggatgatgccagatcctgatcctaatgaagttgtaaaagctgctaaaattgctggtgtacatgagttaatacttagcttaccaaatgggtatgatacagttattggttctaatggagtagtattatctggaggacaaaaacaaatgctagggttggcaagggcattttatggtaatgtaaagcttttagttctcgatgaaccgaatgctaatttggatggaaaatcagaggcaaatttgattaatgcattactttatgcaagaaagaatggtattactacttttattatgactcataaaatacagttacttaatgctgttgataaggttatagtgatggctgatggtatggttagtggtgttggtgctagagatgaaattttaagtaaagttgttcctaattatactccatcaaattctcagcctaaacagcagaccaagccgttagtagagtcagaaaatacatagtatataagtacctatatattgttctgatttatagaggatatagtatttataaataagttttcaaggaagatgaattatatattactggaatctcaccaatacaaaataaatcttagtatagtataattcgcagtacagattatacatgtaagaaaaaatttattgatttacaaccaataatacaagaaaaggcagaagttttatatcttgatgaataatcccattattttatggtaaataccattataattttcatcattaccaatataaattgatgtaacaatgcatattaattttaatatacactaaaacaagtttaaattttttactatttctataatcatatgctattacaaacccagtacaaactatgtattgtccaagtacaaaaaacatcaatttttaaagagataacgtaagtaataatgttttagtatacacattatcagtaatatttccacacaacacacattaaaaccaactttttataggaaaaaacacccatttcttgaccgtattgtttccctatataatcctcagctagaaagtagcaaattacatattcactgaattaatcacacactataacttttcttacatagtaaataggaaaaatgcatgttatatacttaacagtaagagaaactttgaaatattgactgctgtaattattttaattatgtgatcttgatttatcatggtagtttgttggattttagttaaagttagttgtcaagataagagattgtgttgttacgtttaaaaaatttgtggtggttttgatgatatttttattattatgctaattttacaatatatgtactaaagtataatgctgtttgttattaattaatattgatgtcttaaattaaaaagatatcatttagctgtttgataagtattctaaatgtaattacgttctatttaattatgtgatgttatggtaaaagttattattattgataaaactggtagtgctgaagttttaaaatatgttaatcataatattggtgaacctaaagatgatgaggtattgataaaacatacagctattggcttaaatcgctacgatcttgagtgccgtaatggtatgcgtaaaaataaaaaacttcctgctgttttaggagttgaggcagtaggtgttatagagagattgggtaaagatgttgaagtgtttaatattggtgatagagtaggttattgtactgtatctggaggggcttattctgaaaaaagacttattaaacaaaaatatttagttagaatacctgatgatattactgatcaagtagcagctgcggtattatttaaaggtatgacagcgcattatcttacacacttagtttatgctatacgtcctaatacttttgctttagtgcatggagcaacaggtggtgtaggccaaatattatgtcagtgggctagttataaaggatgtaaagttataggtgtaattagttctgatgatagggctaatattgccttgcgtgctggatgttcatatgtagtaaataataatagtaaaaattttgttgagcagatcatggaaattactcacggttctggagttaatgtagtttatgactgtataggtgatttagctagtaaagtatcttttgaatctctttgtatgtttggtatttatgtttcttatggccagatatcaggacctatttcaaatgttagtgcttctatgctaagttccagatcattgttttttacctctcctttggtgttccactataaacgttctagttttgatttggcgatgacagctatggagctttttgaagtgataagaagaaattatataaaagttgggataaataagatttataagtttggtgatatagtaactgcacatcaggatttggaaaatagaaaacttactggttcaaatattattgaactgtagatgttttataagtgagcaaaaagatattttacctttttactatgataagaaaagttatagtgcgtgattaattcagtgaatatgtaatttgctactttctagctgaggattatatagggaaacaatacggtcaagaaatgggtgttttttcctataaaaagttggttttaatgtgtgttgtgtggaaatattactgataatgtgtatactaaaacattattacttacgttatctctttaaaaattgatgttttttgtacttggacaatacatagtttgtactgggtttgtaatagcatatgattatagaaatagtaaaaaatttaaacttgttttagtgtatattaaaattaatatgcattgttacatcaatttatattggtaatgatgaaaattataatggtatttaccataaaataatgggattattcatcaagatataaaacttctgccttttcttgtatcattggttgtaaatcaataaattttttcttacatgtataatctgtattgcgaattatactataccaagatttattttgtattggtgagattccagtaatatataattcatcttctgctctagtcatggctacataaagcaatcttaaatattcattgtattcattagtcttttgttgagattttagattttcacagaaatcattgatatcattgcgtatccaaaatggagtatactcctcatcaaatactaattgggtatcactttttggaatggtggttgtatctgataggaatactataggagattgcatgccttttgcgttatgtactgtcatgatttttacataatcttttgtaagattgatatcactttttatttctgggttagtattttttatccagtgtataaatgcttgtaatgaattgatattgtgggattcgcattgtattaatagattaatgaactctcctatgattttagtgtttgattgacctaaccgctttgtgaatttgtgcttgtgctctgatataatatggtgatacagatttaaaggactatggagttgtgatacgctaatcagttgttttaggtaatttgatatagtactgaattttgattgtaattcttcccataaatatgtgttatttctgttgtatgctaaatcaaaaatttgtttttcattgaattcaaaaattggtgattttaataaacctgttaatgctaagtcattttctggtaatagtaggaattctcctaaatttacaagatcttgtattattgtgtaatccattattttaaacttatctctttccaatgttggaatatcgagtttttttagtgaagttataacgtgatctataaaacaagttctatgtctaactaatattaaaaaatcacctgctgttataggacgattttttgctaatagaattcttttattaattatccatgaatgaattttattagcaatggttgatgcaagcaataggttggtatctaaatcagtacgattttcgaaatccaatgaaaagtttttattatttttaatatcaattatgggccatatttctacgtatcctggatcgttttttcgaaagatttcatgctctatttttgttgtactaaaagatatttcttggcaaaaattattaaatactttatctactaattttaaaatgggtggtgttgatctaaatgattgtgtgagatgtaatactttatgtttatattgtgtactttgttgtgtaaagtaatgacacataggattaaagtaatcaggtcttgcattttgaaaaccatatattgactgttttatgtctcctacgatgaatagagttcttagttcttctgtcgtacctataccagaaaagaattcatgacatagttgtaaaataatactccattgttttatactattatcttgtgattcgtcaatgagtatatgatctattttactgtctaagtgaaataatatccaatctttatatgttggattttttagtaagtttaacgctaggtctataatgtcattatgatctaaatagtttagtttttgtttatcttgttggtatagcttagtaaagcattttgcaatttcaataagatggatagtgcgttctgctattttattagtatgaaaggtttttataaagtttagtatttcttcttgtatatctgaaacaattttctctatttcaggagaattagttaacgttttttttgtaattattgatgatatagattttttttctagggatggtaaattgataaatatttttacgtacttatttaatttttgtagtttatatttttgtgataaattgctccacttaactaagttctcactaatttttttatcccttatacttccttcacttagaattttcgttaaatgattcagtgtgttgttatcagtggggaataattggtatgtttctgtattattaatattattaatgttgagttttttatatattgaattttgattgaagttgtaatgctgtttatttaataacttgtataataaatcatagattgtagcttctgttatttcatgtgaaatagctgataaatgatgttttgttgttggatcatgtaataatttatgaaaaatttttgtaaaggattctgagaaatctttaatactacagtcaggagcaattcctgtttctatgggaaaagtagatattaattgataacaaaagctatgtatggtttttattgaaagtgatacattttgtaaattgttgaataattcccttgctcttttgtattcttttggagttatattagttggaataatgtcttttaatgctttttttaattcttcattttttaatattgcccaagtgcttatgatagaatgtattctctctgtcatttcatgtgctgctgtatttgtaaatgtcaagcaaagtatatttttatggcctgtaactaataatcttaggaccctgttgactaatatttttgttttgcctgttccagctgatgcagatatccatataaacgagtaaaaaggattagttgcaatgttgttcatttgatgtataatccacaatatttctatttttaatgttaataaaaaattatattaataacagtaattattgttgtaaaagattttattagttaagagagtctttgatgaaaaggttgtttctatttgtgatgataataagttttatcaatgcaacagttggatttgctcgtagtttacgtgctgatggtaatgtttatactgctgggataggagatgttgatgaagatgaatcttcagataatggtgaacaatatgatgaagatggggaatatgatttagatgatatttattatgaagatgaaataattgatattcaggaaaacgtagatgatgccatttatactgctagaatggaagatatagaggattcttatgaggaagaattcttggatgatgatgaacaatatgatctagatgatatttattatgaagatgagataattgatattcaggaaaacgtagatggtgctatttatactgctagaatggaagatatagaggattcttatgaggaagaattcttggatgatgatgaacaatatgatctagatgatatttattatgaagatgagataattgatattcaggaaaacgtagatggtgctatttatactgctagaatggaagatatagaggattcttatgaggaagaattctcggatgaagatgagcagtatgatgacaatgaacaatatgatccggatgaggaagaagaggattatgatgatattttgtatgaggaagatgattatggtcaggtagatggtgatgaactgcttgatgatgaaagtctcgatgaaggtaaaaatgtattcctagaggaatatgatgtacctcagtatggtcaagatgttgctgaccaaaatcaagaagtagatgataagactttactcaagtctggtaatgcaaaagatcagcagttaaaagctccagataagaatgctacaaatgaaactgatggtaaaaaaaaactcctgaagtattaaaagatgcatttcaagtacaaaataaagtggaaaaaagtaatgtttcatacaaatggccgtttacaagaaatgttatagaagagattgaaagatcgaaatatgatgaaatgaatgaacatcttccaaaaatatatactgttgaggattattacatacaaattttttactgtataatgcaaagtgatgtttctggattgagatctttaattaataaattgcaagaattaggtgtaagtttatcaactatactatatgaagtacggactttagatgttggagataatttattaacttatgctgtaaaacaaaaaaaattggatatagtgaggttcctattatcaataggtgctaattcaaatgttgcaaattataataatgaaactcctttaagtatatctatagaaaatggtagtatggacatagctcatgctatacttgttgcgcagtaaaagttttctacataagttgttacagacattaatatatgctgtatgtttcgatcttaattatgtaggttttttataatgtttaacagtttttggaattttataattcaatttgatgatgtgctagtttaacgtcattaattttacttagttaatttgatatacataagtgtactatgttgatgtttttatgtatcatcaatatttactggattattgaaagcaatattcaatgcttatgggaggcgtattgtgaatagtaaagaattttgtgataagaaattagtgcacattaatggattttcaatgatattttggtgtattgtttttattttgttgttgttgtctggtatatactatggaaatttttttattgtgttaccaatgtctctagtgtcgttaatttgtacatttattattccaagtggattttttgtgaataatcctaatgaagcaaaagttgttgaattttttggaaattatattgggactatatttaagtcaggttttttttggactattccctttgttcgcatgaggtcaatttcattaaaggtgagaaatgttaatacaagtaagatcaaagtaaatgattttaatggtaatccaatagagatagctgcagtagttgtgtggcgagttgtgagtcctgcaaaagcttgtcttaatgtgagtgattatcaagagtttattaatattcaaaatgaagctgcggttagggaattagctggtagctatccatatgatgctgaagataatagtgaatctttacgtaataattcgacaaagatctcgtctaagttacgtgatatgttacagaatagattagatttggtaggtgttattgtagaggatgcacgaatatcacatttagcttactcttctgagatagctcaaattatgttaagaaggcagcaagcaaaagctattactaatgctagaggatatatagtaagaaatgcaatcattatggtagacgagatattaaagcattttgaattgcaatatcaaattaatctttctgatgagcaaaaagttaaacttgtgaataaccttttagtatctttaatctcagagcaaggaactcaacctactattaatatagaataatatgtattagtatattttcaataagactcaatgtgtgtaatgcattttaaatagtttataatcctgaacaagtttacataaatactatatcattttttgtaatgttgctaaaaatgtgatcagctttaaagcgtatatgttatataatttgtaatgcaagagtcctgttatttattatgcagaaaatttaagtagtatatgtattactaataattttattaataagatttttcttcatatgagtacttaattttgtgtttcaaaatagttactttagaatctgtgactaatctcagtgtattagaatagtgtttagatatataaaagatatttcatagaaataacacatgtaaatgatttatccaactcttgctttttatttctcctaagttttgaataaaaatattttaacaagataggttaattatgaattatgatacattaaatttttatgaatattatgatacatgtgatgtggattgtgcagattatgtatgtagtaatggagtgttagaggaacatatatcttatcagtcaatgtggaaagcagttatacttcaagcaataattgattcgacatctaattatagaaggatggaaaataagcttgagaaaataaaagctactaattggcttaatgacttttcgagagattttataactgtttgtcattttgcgggatataatcctttaagtgtccgaaataaagcaaagagaattatctcagataataaaattttaaatgaggataaaattagaggttagataaactaaatctcaactgtataacttttaattttgctgttaaataatctgcaagttgagatttttaatttatatgagtattagtgatagtaattaatatttgttatatattggttttttaccattttattgattaagtttatgataaaaaagggtttattttttcaaagttctaagttaatgattactatgttatatcatatatggaaatctcaacttgtataacttttaattttgctgttgaataatctgaaagttaagatttgtaatttatgtaagtactagtaatagtatatattgctttttatcattctattggttaagtttactctaaaaaagagtttatttttgtcaacgtgctaagttaatgattattatgttatatcgtacatggaaatctcaacttgtataacttttaattttgctgttaaataatctgcaagttgagattttattttattctaaatatagaatgaagtattgaaagtaataaatgtggttttttatataaattttcttaaaaagtgtgctaatgttttatgaataatgaaaaaaatgaaagaaatttttgatcactattattctatggtggatagtggtaaaatcacttatgatgagcagcaagttaagctattaaacgaattaacaccatatttatctgttgagaaaatttgttgctttttgcctataaaaaagagactacagaaggttggggtatacatatatggagaagtaggcagagggaagtctatgattacagatatatattataatgcttgtaaaatagaaaggaagaaacgacaacatttcaatcagtttatgaagacagtgcatactttattacatgagtttaaatcatctcgtgtcaaagatccactgcataaagttgctaaaacaatggttcatggtgtagatttattatgtctagatgaaatacaggtatatgatatttgtgatgctatgatattgggtcgattattttctattatttttgatcagaaagttattgttatgatgacttcaaattatgctcctgtagatctgtatcaggatggtattcaaaggcaatcttttgaatctacaatatcattaataattgagagaatgtgtgttgtacatttatctggtaaacaagactatcgggctattaaggatttagggataagtgatatatattttataggagatgattcttatataaagttatctcaattgttttttgaaatggcaaatggtaggagggtagaacctgtaacattacatgtttgtaggagaaatattaaagtgaataaaacttttgataatgttgcatggtttgattttgatgagttatgtggaaaagcattatgggtatcagattatcaggaaatagtacgtaatttttcagtaatatttattgcaaatattcctgtgtttaatcattataatcaaaatgagatgcgtagatttactattttaatagatgaattatatgaaaacaaagttaaaattttttgttctcttgctgtagagcctaagttgttatattacttgcaagaggtacctgtggattttcaacgtactatttcgcgtttaatggaaatgcggtcaccatcttactataatatttaagttgttataaattatgttttttattgttagaaatacttagcattgtttagtaagcatttatgtagattgataaataagatcatttttattatgttgtttaaatgtcctggtgatttattatatagtttttgctaacaggagtaattaaaatttaaaaatatattttaatgaaaataggacatggattttgttatgtccttgtatatagtctcttttaagcatctaattatgatggttactgctgttatcttttgtattactttggtatttgtttataacttgcttacaaggagtaatgtaaagcttcaaaacacattttacattgaacagagcatatattttttgatgtgcttgtgtgtacatttcttttaagaatctgattatgatggtaactactgttatcttttgatattactttttagtatttgtttataacttgcttacaaggagtaatgtaaagcttcaaaacacattttacattgaaaagggcatatattttttgatgtgcttgtgtgtacatttcttttaagaatctgattatgatggtaactactgttatcttttgatattactttttagtatttgtttataacttgcttacaaggagtaatgtaaagcttcaaaacacattttacattgaaaagggcatatattttttgatgtgcttgtgtgtacatttcttttaagaatctgattatgatggtaactactgttatcttttgatattactttttagtatttgtttataacttgcttacaaggagtaatgtaaagcttcaaaacacattttacattgaacagagtatatgttttgtgatggtttgtgtgcatatttcttgtaagaatctaattgtgatggtaactactgttatcttttgatattgctttttagtatttgtttataactttgcttacgaggaataatgtaaagtttcaaaacacattttacattgcacagggcatgtatttttgtgatgtgcttgtgtgcacatttcctgtaagcacttgatgtaatattcattgttgcttaatgtaggtactctgaagaacatattttcttttgatatgattttcttgcactctatatctaattctactagagtttcagaattttctgatacaaacgatataggaactaatactataggtacatcatcttgttttgcttgattaattgctgatattgtactgggttctaaccattttatgttgccaactttgctttgataacatattttataatctaatgatgatatatttaaagacttggtaattaataatacggtttgttctatttgatgttggtatgggtcacctcgttgtactatactcagtggtaaactatgtgctgaaaataatattcttggtgatccataattttgtgcttcccggtatttttctataattaactggcagtgtgcttttatataattttcattattataatagcaacaaatcgttgaagtagggcagtgaaatctactttttttcatgtgatagttccagtgttggatagctgatagtgtggtggttgttgagtaatgtggatataaaggtattagaattattttgtctggacgatactgacatacagattttattgtgcttttagctgaaggttttgaatgtcgcatgaatataaaaactttgtattggttttcattgtgattatttaatatgtgttcaagagatgaagcttgtatttttgtttcgcttaatattggtgactgtccattaagatgtttatatatttctattgcttttctctttctgaagaatgaaagtaatgttgccaatataaaccttagaggatttgatatgtttataatatttttatcataaaacaaattgaataggaacggccttacttcacatagtgactgaggaccacctaaattaaataatactactgctactttttttgacacgtattgtttgttcattatgagctaacaaaataacacatgtaatgctaattatcaagaagaaagaacagtatagctttatattatttatgttgtgaagaagatgtactttgagatacaggctgttctacaaaaaggtttacactactctcatttgttgtttctagtaatccttcatgttcagagctgtcacttgatcttcttaaaagtgttgatacagatctacatctaggttgtttagatgttattgtcaatagctcgtcaaggtatgaaataggggattttgaagtaccatcttcctgttttattattttagcgtttaatatcccaaaactacatgttacgattaaatctctacttcctgcatataataaactagctatgttctcaagatttgctttagaatgtgaaaactttttttccatttgagaatgtgttagtgtgttatacaggagaatgcataaatcaagtaagaaactaaatgggagttctaatatttctatgatgcaaagaatgaattctgcagctgcttttattcctattaaaggagtcattagcatagaaaaaaggatagtttttatagtacatgctgcaatgttagtagattctacaaaacttccttcaagcttattgatagacccaggtcgtttaaagttaataaaatcattgttatgtaaattagggtttctatatattggatgttttatcggaccacaacaatcttttcttatacttagtattcttaaagttagacaaatcattatcataagataatacatgcagctaagcatatcaggtgcatttgtaatgggtttagtgttggaaatattttatttccaaaataatgtgttgcgagaaataatgtaggcattacaagcatggcttcaaaaaatgggattaagtgctttcttatttgatgttttgcattctctttattatctgtaaccactgttctttggaaatttgtcatgtgtttactataatgcatctcataaagtgacatttccaatagactaatggctgccagattaaaagttgtccatccctttaatccacaaaataatgagttttttaatttaatatgaaaatttgaaaagtttaattttgctgtatgcacggtaatgtttcctgttgataaaatactattatattatactttatttattgtagtagtatattaatatatttgttatcctgtattttctatcattaatagcatacatgaacccccaatgctatttggagtatgtagtgataataagattgtattaatacctaaagaactaaattgctatatttaaaaaatgataaatgaagtaatagtacatatcctaagatttttctaaattatgaattaatttttctattcttaataatgtatgtgataatatattacttacttcgttttttatttttaaataatcatcaaagtattttttatacgttaacatttcatcttttgttttttttaattgagtcttcagttcgtgtttctcatcttctagtgttaatcctgctagtaaaaatattaaagcatcagaccctttgcctttttctgcacttgatattgagttaactaatgcattgaatttatctactaaattgcgtaagtgtggttcttctgttttattacatgctactctgtatgtgttatttctgacagtaatttcaataacttgtgggttagagttattcacttacttgctcctttttaaaatagctttgatattttctattgtagaatttaaacgatgaatagtttcatgacatatttctttccaactgttacattcatttgttttgtttgtaagttgttgatctaacttatttttttcttcagtaagtaattctatagttgctttatattgggatatattatttttattgtttagtttttgtattaataaagactctaatctgtcaaatgctttgtctaaattctgttggaattctgaattgttatttatttgattcataataaaccacattctaataagtctatatttagtttggttataacttattgatttataatcttaataaatttactactagctctaaagtatactttcttatacttactttttgctaaccttgcattagcagtttttatattataactccttactgtaaatgatccaaaacctcttaattctaccctacaatcattctttaaataatctacaattaatgaaaagaatatatttaatatcttagatactatctcttcactaagagaaggatttttttttgatatgtgctgaattaaatgtgattttaacatgatatttatttattaatataataatgaacaacctgagatataaatgaacttacattttcaattatagatttgtgttttttttttgataatactttgactttctgtgtgctaatattttgtgagtggaaccaattcattgcttcatcttgtccaccgatctgatcaactaaccctatagataatgcttcagaccctgtatatatactgccatttgctatctttaatacctggtccttttccatttttctgcggtctgctactatatcaacaaagtaatcatatgagtttttaataatacgacgtatagattcttctttttcttctgttaactcttcaaaaggagatgtttctgcttttagatttgaggattttattgattttaaagagatacccattttttctgctaaagggttaataccaatgtattgcattaacacaccaattgatccagtaatagtggtatgacgcgctattatataatctgcagcgattgcagtcatgtatccacctgatgcagcaaaatcatttaacagtgcgactactggcttattttttgaaacattacgtatattttgatataaaatttcactgcctgtaactgaacctcctggactgttaatatttaatatcaaccctgtaacatgattgtcttcggcaatctttttcagtaatgcatccatttcttcgtttgtttcaatttttccttcaatattcactttagcaatatattcattgtctaaaaaactactaatctttgatatgtcaatatagttaactaacattaacaatacgaatatcataaaaaatgcaaaaacccgccataactttactttagaatttaatacttctatttttagtaattgatcagacatgagataaacctattcagtgctttaatgatagtatcatattataagtttcaataagcaatacttcagcttctaacctatctcctgggaagaattttttattatcaggtaggtattcttgttcaattagtaagttgaaactatttgatccattgaatacatcaactaatataccagtatcttcaacaactttggtaactgtaactggtattttatctcctaagttaattttctttaataaatcaagaaaagggtcatactctagttgttttactccaagatctatcttgcttttatttggatttatcatgagtatttttgcttctacagaatctccaacgttatatttttttattgctgcttctggtgataaggaccaacttaactctgtagtacgaattaacccttcaatgccatcattgagtgtgttatcctgaaatgaaacaaatataccaagatttgtaatattttttatctttgttgatacaatagaacctaaaggatactttagtgtaaacgcctgccatgggttatcttgacaccttttcatactaagactcatgcgacttttagctgtgtctatgcttaataccttaacttgaatttcttcacctctcataaataactggtttataggaagagaattttttgtccagcttacttcggatacgtgtactaacccctctatccctgtttctaattcaacaaagaccccatattcctcaatgcttgtgacaatacctttatggatactatcaacaggatattttttctcaatatttgaccatggactttcctctaattgctttacaccaagagaaattttcttattttcacggtcaatttttataatttttgttttgacagtttggccacatgagaaaacagctgaaggatgacttacacggctccatgatatatcagttatatgcaatagcccgtcaactacacctactgaaggagattcatgtatttctatgaatacaccatatttagttatgcttttaactttaccttcaataatatctccttcatttaattggctgagatataaacttttagcatctgcaagtgattcttctaatatagcttttcttgagactacaatattaccttgctttttatccatctttaatatacggaacttttgctttttacctaataggggagtgatgtctttaacttgtcttagagctacatggcttgctggtaaaaatgccacaacaccttttatgtctacagtgtacccacatttaattgagctaaatattactccttcaacatcttcttttttttctgcagcttcttcaagtttctgccatagttcatctctgatagctttttctctacttaatactacactaccattacgaccttcgattttctctaagtatagctttacttttgatcctatactaatattctgataatcatcaccaagctcaaattctttaagtgaaacaatactttcggattttaatcctgagtctattgttacataccccttatctatgcatataatagtgccctctattatttgtccttctttgacactgtcatcaataaattcttttaacgcatgctgaaactctgagctactatcattatcggaatcttctacttcaagattatggctaataaacttgttggattttattttctttatattatgtaaataattttctgatcctaaatttgtttttgtttgaaggtcttccataaaatatagcctattttaaaattagcaaaagcggtaaaaatcatattattattatttaccatactttacaagtaggtttttattttttctttaatgtataaaagtacctgttctttattcatgtatgaagtgttaatgtatagggcatcttttacttttaccaaaggagaaaattttctataggtatctctaatatccctttctagtatttgtttgtgtatttttttatacatttctttcttgtgatataacatttctttaaaccttcgctgtgctctaatagatgcttgtgctgtaataaaaattttaaggtctgcttcaggaaatactgtagaagatgtatctctgccatctaggattatacctggttctgctagatggataagtttgcgctgtataggtaataatgcaagtctaatgtgttgatatcttgctaaaattgaagcagttttgcctatgtcttcattattgtatatagtattattatcttctaagagcagtgataatattttgtcctctaatttattgtcaatttttagatggttttgtgctgatgttccaaatattgtagctattatcctgtataattttcctgtatctaaatactgaaagttaagaaaatttgctaatttttttgctaaacttccttttcctgaagcagaaggaccatcaattgttataacgaaattattgcaatgcttggtcataattttgtataaaaatggaatatagtgctacagctgctgcgtttgatacgtttaagctatcaattttttttgatattgcaatttttagtaaaaagtcgcaattttcttttgttagtttacgcatccctttatcttctgatccaaagataattagttttttgctgtccaattttgttttgtgtagaaattctccttcttttgcatcaaatccatagcaccaatatcctgcttttttgagtaactttattgtgttgacgatgttgatcacatatacaatgggaatcatatcgacagcgccacttgaagtttttgacataccacagttttcagatggtgaattgtggtaaggtaatataattgcatccacattgaaacacacagctgatctaataatggatcctacgttatgaatatctgtaacttgatctaaaagtattattgttgaactttctttggatgtatttaatacctcttctactgttgttgaatcaataactgaggcttttaaagcaataccctgatgattgctgttatgtggtaatactgaattgatataattaggattaacttgttttaagtttatattcttttgtttgcataatcttaaaattttggatatttcattattatttttcataaaattttctgttaccagaagttcatgacattttctatttttattctgtaaagcagcggtacatgggtgtttaccgtaaatccatatcttgtttttgtccataaaaatgtgactattaattttgactttttttaattaggtattgacatattgtaatctttaatttagttaaatcaattctaatctaaatttttttggtatcattttttgtttttttgtgttaattaatacaaggatgttaggttagcgttagtgtttttaggaggagtggccgagcggtcaaaggcagcagactgtaaatctgcccactagcgtgtacgtaggttcaaatcctacctcctccacgggagattatgcgggtatagctcaatggtagagtcccagccttccaagctggctacgtgggttcgattcccactatccgctctttatttttgaaatggtttaatgatgttaaaggtatttgtttatggtagaagaaaggaaaccacatataaatgtagggacaatagggcatgttgatcatggtaagacaacattaacagcagcgttaacaacagtgttagcgaagaggttgagtggagaaggtaataaaagtgtaaagtatgacgaaatagataaagcaccagaagagaaagcaagaggaataaccatttcaacagcacatgtagaatatgaaacagagaatagacattatgcgcatgtagattgtccaggacatgctgattatataaaaaatatgataacaggtgctgcacaaatggatgcagcaatattagtagtatctgcaacagatggagcaatgccacaaacaagagaacatatactattagcaaaacaagttggagtaaaagatatagtagtatggatgaataagtgtgatgttgtagatgatgaagaaatgttgtcattagttgagatggaaataagagaattattatcaaaatatggatatccaggagatgatatagatgttgtaagaggatctgcagttaaggcattggaagaagaaacaggttcaggagtctggagtgaaaaaataatggaattgatgaatgccttagaaaaaataagtttaccaacaagagaaaaagataagccatttttaatgtcaatagaagatgtattttcaatacctggaagaggtacagtagtaacaggaagaatagagagaggagtaattagagtaggagataaaatagagatagtagggttacgagatatacagagcacagtatgtacaggtgttgaaatgtttcataaagcattagatgcaggagaagcaggggataatgcaggtatattgttaagaggaataaagaaagaggatgtagagagagggcaagtattgagtgcgcctggtcaaatacattcgtataagaaatttaaagcagaggtatatatattaaagaaagaagagggaggaaggcatacaccgtttttctcaaattatcagccacaattttatgttagaacaactgatgtaacaggtagtataaaattacctgagggggtagagatggtaatgcctggggataatataagtatcgaagtaagtttagataagcctgttgctattgataaaggattgagatttgcaattcgtgaaggtggtagaactgtaggctctggtattattactgaaattttggagtaggtattttatggtaacgcaaaaaatatatattgagcttaaagcattcgatagttgtttactggatagatctgcacgtagtatcattttaactgctaagaggagtggggcacgtgttaatggcccaattttttttcctcgtaagattatgaaatttattgttaaccgatctactcatgttgataaaaagtctagagaacagtttgaaattaggacacataaacgtttaattagcttgccaaaagctaattctacaattattcaggcattaatgagtttgcaattgcctgctggtgtagatgtaaaagttaaagtgattgggggcagcaatggctaagagaataggattatttctagaaaaagtaggccatacggcaatttttgataatgaaggtaaaaggattccaattactttattacatttacgagattcttttattatttctaaaaagactaaagatattcatggttacgatgcagtggtattaggggtagaagcttctattaatttaaagaagcctcaatcaaagattttagagaaaagcaaaattactgctaaatgtaagatttttgaatctagggttgataatttaggtgatgtagtagagggagctaaagtttctattactcattttgtcaaggatcaatatgttgatattactgggtattctttagggaaaggttttgctggtgttatgaagcgacataattttaaaggattaaaagcatctcatggtgtctctattgctcatagatctcaaggctcaacaggtcagtgtcaagatcctggtagagtatataaagggaagaaaatggctggtcaattagggaatagtaaagtcacagtacagaatcttaaggttattttagttgatcaggagagatctttattaggtgtaagaggtaataatattcctggggcgaaaggttcttatgtttttgtaaaagatgctgtaaaaaaatcagttccaaagggttcttttcctatatgtgctgaagatttaaagttagataatgttgtgtgagatcaatatggaagttaatataataaatgtaaatagtgataggattgggacgattgatttaaatcctctaatattttctgtgaattatagaccagatatattaaagatggtagttgattggcaattatctaagaggcgtgctgggacacataaagcaaaaactataggtgatatttctggtacaactgctaagcctcatagacagaaacatactggtagagcaagacaaggtagtttacgtagtccacaatttagaggtggtgctgttatttttggacctgtagtaagaagtcatgcttattcattgaataaaaaagttcgcaatctggggttaaaggttgctctatcattaaagaattcttgtaataaattattgattttagacagtattgatgttaattttgtgaagactacacaagtgttacaatttattaagaattttgagcataagtcgtttctgattattgataaggattataataaaagtgtagtttgctcttgtagaaatttgcataatgtaactttgttaaagcaaattggaacaaatgttttagatattttaagacatgattgcataattttaactgttggagctgtaaaatatttagaagaaaggttattatgattaattattttaacgttatacaatcctctattattacagagaaggcagtattgttgaatgagaaatttaataagtatgctgtatatgtctctgttgatgctgataagcaaagaatcaaaaaagctttaaaagtagtatttggtttggatgttattcgtattaatatcttgaatcagaaaggaaagaaaaagtatttcaaaggtgtatttggacgtaggaaaaataggaaaaaggtttatttttctttgccaaaagatcaaaattttaaatatatgggaatgaaatagaattaatatgggtattaaaaacttgaattcagtgacagcatctttgcgtggtactgtattattagataaatcaatgctatggaaaggtaagccagagaagtctctagttagttataaaatttctcgtggaggtaggaattctcgtggtgttattactgtacgccatcgtggtaggggtcataagcggttgtatagagttgttgattttaaaaggaataaggttggggtttctgcaactgttgaaagattagagtatgatccaaatagaacagcatttattgcattgctatcttatgatgatggtgaaaaatcttacataattgcacctaatgggttaaagaaaggtgatgtagttatatctggtgatggagctgatatattacctggaaattgtcttctattaaaatcaattcctgtaggcacatttgttcataatgttgagttaagacctggtaatggtggagtgattgcaagatctgctggtacttatgctcaattgatgagtaaagatggtatgtatgttttattgagattaagttcaggggaaataaggaaggtattatctgattgtcgtgctactataggtatagtatctaatttggataatcaaaatgtaaagttaggtaaagctggaaggagtaggtggttaggtattaggcccactgtgcgtggtgttgcgatgaaccctatagatcatcctcatggtgggggtgaaggtaaaacttctggtggtagaaatcctgttactccatggggtgtgccaacaaaaggtaagaagactagaaagagaaataagtctagtaataagtatattaagcgtgtatctgataaagggtagaatatgtctagatctataaaaaagcctcctttttgtgcgccacatgttttacggttagtaaataaggctatagctcaaaataaattaaattctattatcaatattcactctaggtcttctgtaatcttaaataaatttataggtttaacttttggggtttataatggtaagacttatgttcctgtaaaagttaatgataatatggtgggacgtaaatttggcgaattttctccaactcgtcgttacactggacatgtgggtgataagaaggtatctaggaagtaaattggttaggttatatgagtaaagtattgatagtagctaaaggtatggggttgaagtctactccttctaagttaaatttagttgctgatttaattagagggaaagatgtgtctgttgctatgatgtatttaaaattttgtaggaaaaagtctgctggatatatcagtaaagttttaaaatctgctgttgctaatgcgcaagctaattataatattgatcttgataatctttacgtaaaagaagttttagttggtaagtctttttctttacgtaggattcatgctcgtgcacgaggtaaagcatgtagggtgtataagcattatggtaatgttatcataaaattatttgagaggatataatttatgggtcagaagtctaatcctattggattaaggttaaagataatcaatacatgggattctttgtggtatgcaaataaggattatactacaaagttacatgaggattttttattgcgtaagtttataaagaaagctttctatcatgcttcaattagtaaggttgttatagctagaaaagtagatgtaattatggttaatgtatattctgctaagcctggtgtgatcataggtaagaaaggtgctgatattgataaagtaaaacagcagattgttaaaatgataaataataatattgaattgaatataatagaggtgaaaaaacctgaattaaaggcagttttaatagcagaaaatatagcacagcaattagaaaagaggatatcttttagacgtgcaatgaaaagaagtgtccaaagctgtttaaaaataggtgcaaaaggaataaaagttagctgtgctggtagattaggtggggctgaaattgctaggactgaatggtataaagaaggaagtgttccattgcatactttcagagctaatatagattatggtttttctgaagcaaaaacaatttatggaataataggtgttaaggtttgggtctaccttggtgatacgaagtcaagtaatgaataatgagtgagtagagattatgtttatacctaaaaaaactaagtataagaaggattttaaaggacgtattagtggtaatgcaaaaggtggatatactttatcttttgggtcccatgggttgaaagctttagagccaagtagattaacttctaaacaaattgaatctgcaaggagaagtatttcaaggactttaaaacgtgttggtaaagtatggattagggcattttgtcatacttctgttagtaagaaacccatggatgttcgtatgggaaaagggaaaggaagtgttgagatgtgggtatgtaaagtaaaacctggcaagatattgtttgagataggtggagtgccattaaatttagctagggaggcattgaataaagctcaagctaagcttccaatgaagtgtaaatttgttagtgatgaattgtaaaggtattgagctatggatattgttgatataaggtctaagagtaatgatgagttgcgcgaactattagtaaatttagggaaagaattagttaatgctgtattgaataggaaagttgataaatcaacaaaccacttttattgtagaaatataaaaaaagatatagccagagtattaacagtattaaatgagagaaggaaagaggaaaaacatgtctaataagaaagttttaacagggattgtagttgatgcaaaatgtgataaaactataaaggtaatggtttctcgtatgataatgcataaaacgtataagaagatagtaaagaaacgtaagaattatgtagtgcatgatgagcataatcaatataagtgtggtgatgttgtgaagatacaggagcatatacctatatctgctactaaaaggtggattgtaatttaaaaggtgatattttatgatacagaagaatactttattggatgttgcagataattctggtgcgcgtaaagtgttgtgtatagggttgttaaatggtaagaagtctgcttcagttggggatgttattgttgtttctactaagttaattactccgcgaggaaaggttagtaaagggaaggtttataaggcagtaattgttcgagtaaagaaagcagtacgtaggttagatggaagtgttataaagttttcaagtaacgctgttgtattaattaatgatcaaggtgatccattagggactcgtgtatttggtccaattaagaaattaccttttggtcttttttcaaaagttatgtctttggctgtagaggtgttataaaatgggtatgaagattattgctggtgatgatgttatagtaatcagtggcaaagataaagggaagatgggaaaagtaataaaagttttgaaaaaaaagcattgtggtaaagatgtttcttttgcaatagtttcaggagtaaatgtatgtagaaagagtgttaaggcaactcaaaaaagtgatggtggtattataagtgttgaaaagcctataaatctttcaaacattgcattatttgattctacgcttggaattcaaacaagagtagggtataaatttataggtgagaaaaaagtgcgttttatgaagtcttctggcaaagttatagaataggttgtttttttatgttaaaggatttatataaaagtcatattgtgccatctttaaagactaagcttggatacagcaatgtgatgcaggttcctaaaattgtaaaagtgtgtttaaatataggattaggtataaggggttctgatagtaaggttatgaattcttgtgttcgtgatcttgcattaatagctggtcagaagcctgtggcaacttatgcaaaaaaatctattgctggatttaaaatacgtaaaggatttcctattggatgtaaggttacattaagaaataataaaatgtatgagtttttagagaggcttattcatgttgttcttcctagggaacaagatttcaaaggattatctgtgagtcagtttgatggttgtggtaacttatcgattggtataaaggagcatatttcgtttttagaaatagattatgataaaatagataagatactaggggtagatattaatattgtcacgaatgcagttaacaataatgatgctaaattgttgttaatggaattcggttttccgtttattaattaagggtattcatgtcaagaaaatctgttatacaaaggaatctaaaacgtatatctatttgtaatagattaaagaataagagagaggaattaaaagctataattaaagatcaatctatttctatgaatgataggtttttagctcaggtaaaattatctaagcttcctagggattcatcttacattagaattaggaatagatgtttgattactggaaggcctagaggatgttatagaaagtttaaagtttctcgtattgtgttacgtcaattaggttcaattggacaaatacctggattgactaaatctagttggtaatattgaaaggaggggttagtagtgtctttgtcagatcctattgctaattttttaacaagtatacgtaatggacaattaagtatgaataaggtaatagtagtttcttattcttatgttattcatgctatactacaaattttactttcggaaggatatatagatgggtttactgaaaaatcaaaaggttctaatataaaattttttgaagtgaagcttaagtattataatggtgcacctgtaattagtcagatagctagaatatcaaagccaggtaaaaggtgttattgttcagctaaggatatgccgaaattttataatgggttaggtttgtatataatatctacatctaaaggaattatgtcggattataatgctcgtaaatctggtgttggtggagaaattttatgtggtgttttttaggagattaattaatgtcaagagttggctctatgcctatagcaattcctagtaatgttcaggcagacttggttggtaatcagcttatcttaaagaataatgagaattcattgaaattgactttagattatggtgtgctttgtgatattactgatggtaaaattgtgttgcatgttaatgataaatctatcaagtcaagagtaatgtggggaacttatagaagtataattaataattatgctataggtttgtctcaaggattagtagttgaacttgaagttaatggtgttggttataaggctgaagttaacggtgaatatttatctttatcattgggttttagtcatggggtaaagtataaaattcctacaggcattgttattcagtgtgttaaacctactcaaatattagttaagggttttgataagcaaaaagtatatatggtagcatctgatatatgttcaattagaaaatataatccatataaaggtaaaggtatttctattaaaggtagatatgttcataggaaagaagttaataagaagaagtaaagtggggtaatagttaaggttatggtgtataattgtggtactagacttgaaagacgtaaaaaacgtgttagattaaagttaaagagaaattcatctttactaaggttatctatttttaaatcaaataggcatttttatgttcaattaatagatgataagtgtgggagaacatttgcttcagcatctactttagaacgtgaagttgttgctttaacgaataggagggttaatagtgattctgtaaaaattgttgcaaaattaatgtctgatcgattgaataagttagataattgtaagaaatttattttcgatagaggtctctataagtatacagggatagtttctgagtttgcaaatgaattacggagttatggttttgagttttaataagtaggttttataatatggatgttgtaaagaaatcacgaaatgttcatggttctaatgatttttctgagttgatagtttctgttaggagagttgcgaaagttgtaaaaggtggccgtaggttttctttctcagttctagtagtgataggtgatgaaaaaggtaaagttggttgtggaataggaaagcatcttgaagtatctgaagctaaaattaaagctgttaatgctgctagaaaaaatatgatcagggtacatttacgtgaatctagaactttacatcatgatgtaaaagctaagttttgttcaagtaaagttatgttaagatcagctaaggtaggtacaggtattatagctggtggttctatacgtttaatttttgaagttttaggagtgcaagatgttgtagcaaagtctataggctcctcaaatccgcataatgttgtatatgctgtttttgctgcttttaggaaaatgctatcgccaaagcaggtagctaataaaaggagtagaaagataggtgatattattgaaaataggtaatttatggatacagttgtaaaattgaataatatatttagcgggttacctaaaaataagaagtctaaagtattaggtagaggtataggttgcggaaaaggtaaaacttctggtcgtggacacaagggacaaaaggcaaggtcaggggtttctataaatggttttgaaggtgggcaacagtctatatttactagattacctaagaggggatttaattccttgcttaagcataggtattcaatagtcaatttatcgacgattcaaaggttgattgatagtaaaaagattgaagatgtttctgctattacaaaagaggttctatataatttaggagttatttcttctattaaagaaaaaattaagattcttggaaatggtaaattaaatactgcggtagcaatagaatatgattttatttcaaaatcagcagaatcacaggttactttgttaagtaatgtatcagcaagtaaagaatagaatagtatttaagttcatagttaagtaatattatgtcacaaaaaatggatttactatcttggaataaggataatttattgggtaaactttggtttactttattttgtcttattatataccgtttgggtacatatatacctattcctggtattaatccagatgtaatagatgcagtagttacaaaacattctgtaggtgttttaggaatttttaatgtattttctggtggtgctttaggtagaatgactgtttttgcattaaatgttatgccatatatagtatcttctataattattcagttattatcagtaactattccaaaattaaatgagctgaggcaaaatggtgaattagggcggattaaaattaatagttatatacggtatatgactatttttttctgtatggttcaaggttttgttattttgcttggattagaaaagatgaatactgaaactagtattgtagttattgagcctggtctgttatttcgtatagtgggtattagcagtcttttaggtgggacaatgtttttactatggttaggagaaagaattaataaaaatggcataggtaatggcgtatctatgattatatttacgggtatagtagctgaattacctggttctttttcttctatgtttttattagggaaaaatggaaatgttccaatatttgtaattttattgatgttattggtattttttgcgttattgttattaattatttttattgaaaaatcttatagaaaaatactggtgcagtatccaaaaagacaagttaagaataagttatatggtagtagttctacttatattccattaaagattaatatttctggagtaattccacctatttttgctaatgctttattattatctccgattacagttgcaaattttcatcaaggatctccatggtctgattttatattaatgcatttttcatctggtaaattactatatatggggtgttatgcattattaataatatttttcgcgtttttttatacgacttttgtttttgattcaaaagagacgtcagagatattaaaaaaaaatggaggttttgttcctgggaagaggcctgggaatggtacttgtgagtattttaattatgtaataaagagattaactgttttagggtcaatttatttaacggttatttgtataattcctgagttaataaggtataattattccatttcttttactttagggggtactagttttttgataataatcaacgtaataattgatacgttttctcaggtgcagacacatttgtattcaagcagatatagtacattaattaaaaagtctgagttatggaaaataaaataaatatgttaatttttggtcctcctgggtctggtaaaggtacgcaatgtcatattttgtcaaaaatttatagtactatttctgtaatttcaacaggtgatttgttaaggagtgaagcaaaacttgatactgatgatggtagaaaaattaggcaggttattgaatctggtgatttagtaagtgatgatatagtgtgtaagatgtttgctaagtctattagtagagtaaagagtggatttttattggatggatttccaagaaatttaagtcaagcagaatttttaacggaaattctagaggaatataatagccgtattgatatagtgatacagttgcaattagatttagagacgataaagaataggttatatggacgtattgtgtgtaaaaattgtggacaagtttctaatttaaatttttttgatagagcaatagatgaaattgtttgtaagttttgtaaaagtagtcagttagattatcgttatgatgataaagtagaagttatcataaaaagggttaatcagtatgatagagagattaaaaaattagaaaattattatcgtgataagattgtgtgcattgatgcaggtaagccaatagaagaggttacttgtgatataaaagacaaaatagcccatttaattattggttgacgttagtttgcatatttgctatattacaaagcatttattatcttgtggaggaaagttagtggcgcgtatagctggagtaaatattcctacaaataagcgtatagttattgctttaacttatatatatggtattgggctttctttagctaatagaatctgtgaaggttgtaatattgatcataatgttcgcgttgtgaatttaagtgatgatgaaattattagaattaggaattttattagagagaattatatagtagaaggtgatctgaggaaagaagttagcatgaatatcaagtttttaactgatatagggtgctatagggggttaaggcataggagagggctacctgttcgtggtcaaagaactcatactaatgctaagactcgtaaaggtagatcgaaattgccagttgctgctaaaaagaaataacaaggtatattatgagtgtagtttataaaaagaaaaagagaaatgttgtagttggggtagtttatattcatgctacctataataatatcattgtaacagttacagaccagcaaggacattcgttaatatgtacttctgctggagcatgtggttttaaaggatctaagaaagctactccttatgcagcacaagagactgcaagtcatgctgttaaaacagttgttgaacaaaatgggatgaagacagtatctattaaagtttctggtcctggtgcaggtagggaatcagctataagagctgtgcaagcttgcaatttaaatgttacttctattaaagatactacaaagcttccacataatgggtgtaaacttccaggaagacgtagagtttaagtatatttgttactatgtgaggttctattgtgattttcgatgaggattctaattctattgcacaagattcgggttatatggcagtaggaaatgcatattctaatggagtgagttatatatcaatgagtgatcattggagtaaattaactaagccttcttctattaaggtagttcctagtggtgcttctccaaataaggcagatttaattattgaacctcttgagagtggttttgctttaactctaggtaatgctttaagaagagttatgatgtcttctttgcgtggttttgctgtttatggtgttgaaatagagaatgttttacacgaatttacttcgatttctggggttagagaagatgtaacagatattcttttaaatattagcatgatgagagtaaagctttctggtatgaatagtaaagttttgtctcttaaagttaaaggaccatgtgaagtaagatctggaatgatacctgacactgatgattgcattatactcaataaggatttgttaatttgcactttagatcaaggtgtagattttaatataaaaatgtatgtaaatgctggtaaaggttatgttcctgctgtaaagcgtaagtcagttaataaacttggtgatataccaataaatttcattgcaactaatgctctttatagccctataaaaaaggcgtcttttaaagtagaaagtagtcgtattggtcaatttacagattatgatcgattgattatgtctgtggaaacagatgggtctattttacctgatgaagcagtagcattagctgcaagaattttacaagatcaatttcaaccatttattaattttgatgaaactgatgagcctcataagaaagttgatgctaaagatacattgccttatgattctaatctgttacgtaaagttgatgagttagaactttcagtaaggtcttataattgtttgaaaaatgataatattacttatataggagatttagtccaaaagactgaatctgatatgttaagaactccaaattttggtagaaagtcgcttaatgagattaatgagcttttagcaagtatgaatttgcatttaggaatgaaaattgcgaattggcctcctgaatccattgagagtttaagtaaacaatatagtgaagaatgaggttatattatgaggcatcgtgttgctcatagaaagttttctcgtaccagtgctcatagaatgtctatgcttttaaatttgtgtatatctttaattaagcatgaaaggatatctactactttgcctaaggcaaaggaaatacgtccttatgtagaaaaacttattactattggtaaagtatataaggaaaagaacttagtttatgggaaaagattactaatttctaagattaaaaatcctgatatagctgataagctgattggtatattatcagtgcgctataaaagtagaaatggtgggtatactagaattataaaaaatggatttcgtaaaggtgatagtgcacctatggcaattatagaacttgttgataggcagataataactgttgagagtaacaagaattcctagttttattttaagtattattatgttttttatctcaagtgacttattatgagatttacactttcgtggttaatgcagtatcttgatacagatgtttctttagatataatagttaataagcttagtgatattggtatagaagtagataacgtagattattgtgaacacttaaaaacttttgtagttgctgaggtattggaagtagttcctcatcatgcagctaataggttaaaggtttgtcaagtatttgatggaaaggaaacttttcaagttgtgtgtggtgcttctaatgtaagagctgggataaagtctgtactagcacgtgttggcagtataataccaaaaaatcaatctgtgattgaagtagtaaaactgcgaggtgttgaaagttatggtatgctatgttctaaggatgaattaggaatagtagatcatagtaattctaatgatgggataattgaactgtcatccgcttataatgtaggaaatactttcttttcttgtgatccaattatagaagttagtattactccaaatcgtggggattgtttaggagtatatgggatagctcgtgatttagctgctgctggtatggggaagttgaaatgcatagataataatattgttaatgattctactgcttctaattcttctccagttgatatttgtatgcaagctgaaggaatagttaaggggagatatattaagggaataaaaaattgtgaaagtcctaaatggttaaaggataatctgttagtatgtgggataaattcagtttcgtttgttgttgatataacaaactatataatgctgtcttttaatagaccacttcatgtatatgatgcaagtaagataaagaagaagttaatttttaagaaggcagatagtcaaatggaattttctgctcttaatgataagaagtatattttagggacagaaaacattatagctgttgactcaaatgataatattcatagtgttgctgggataataggttctcagttaagtagttgctcattggaaacagaagatattttcttagaatctgcatggtttaaccctatggatattgttttatcttcaagaaaaattaaattgtctactgatgctagttatcgttttgaaaggtttgttgaccctaagtttttacagactgggctagatttagctacaaaaatgatattggagtattgtggaggggaattttttgatgttgtttctgatgaaaattatctaattaatgatataaggttagattttttgccagaatctgtaagaaaagtgggaaatgttgatattgcaacaaaacaaatttttgattttttagttaagcttggtttttttgtagataatagtaatgaagatgtgtggaaagttactgttccttcatggaggtctgatattcagcattcttctgatattgttgaagaagtacttagattatatgggtatgataaaatatgtgaagaacctatacctatttctcatgttgatgtagttgataactcttatgataggttgaggtcagtactgttgagtgaaggtttgatggaagttattacttggtcatttacaagtatgacatttgctaaaaagttaggatatgattcagaattgttgctacttgataaccctattaatgacaagttgaatttaatgcgtcctagtgttttattaaatttactacaggttgtttctgacaaccaagcatatggaagtagtgaagtagctatttttgaaataggtcaaatttacaatattgataatgtatgtagtggcaatagttatgtagtaggtggtgttaggtatgggaataatttcccgcgtaatctttataaacttgatagatctgttgatatttttgatgtcaaatctgatgttatcagcatattacgggaattgaatattaattccgatgctgtagaatttaaaaaatctgataaaccatatcttcaccctgtaaaatctgcagatgtgtattttaacaatattttgctagggtattttggggagttacatcctgatattatacatttgtacgaaatcaaacgtccagtagtttgctttgaagtatttttatataaaattcctcaaatcaatgtgataagtaaagagtttgttgaatcatgttatcagttagtaaaacgtgattttgcctttctaattgataaaaatataagtgtacagtgtttagtagatgttactaaaaatagcaatagtactttaatcgataatgttgtagtgtttgatttatatgaaggagataatataggtgataataaattatctgttgcattgtcagttacttttaggcctgttgaccacacattaaatgatcaagagataaaagatgcatctgatcgcataattagtgctgttgcccaggagctaggtggagttcttagatctttttaagtgtgtagtgtgctattcgttttatatatattttttagatgttatttaatcactacagtacataagtcagtatgtagtttttataattgtgcattttacttttaaagtgaacaagatgaaaattttgtttttctatgggctgatgttgtttaccttgtaattagttgtaatccgtgattatctaatcagatgtgttttaaaagagtaaagtggatattttattaattttcgtttatttacaatagcagatttacttttagtatctaatatataagcattttctaatgcagactaattttataagataggaaaataaaattctcaatttattgtgggttatagtcttttaagggaatatgtagtcaagattaggttgtttataaaataatatgtattaacatatgttaatattttaattattattaaattatatgctattggttagtataattatccgcaaaataacattattgttatgcaagaatcttaacgataatagagatgttcttataatttgggtaccaatattacagggaattggcataataatatacttttctttgactaatgaaccgcaggatgatgtattagtatacattgctttcttattattggtcggtttggtttttatttgtttaaggaagtatagtattttatttatatcagttttttttatcttattaggatttgttagtgtgcaaataaaagcacattattttgtaggtagtgtattacgacatcaggtgtatgtaagagatgttattgctacagttaaagaaataagtattcaacagtcaaacaaaagattagttgtgtgtgacatcaaaggtagcaaatatggaataaagtgtattaggttaggagttcgtaccaaattagacgataatattacaataggtgacatggtacaattttctgcaattatttatcctccatcagttgctgtatctccattttcttatgacttttctcgtatagcgtattttaaaaatatcagtgcagtaggttttgcagttagtaatatatgcttattcaaaaaaagcagaagtagacgagttacagaatatatagaacttataagattgaatatatataaggtgcttctgcgtagcctaacggaagatagtgctaatatattaagtgcactactaatagggaaaaaagaaggtattaaaagtgatatcatggatactattagaaatacaggaatagctcatctttttgctatttctggattgcatttatcttttattgctgggttatttttttctttatcaagaagtttattagtattgtttacaaaatttgctgaaagctatgacataaagaaaatctcttctgttatagctattgtggtgagcctaatttatttgttaattgctgggatgcctgtttcaggtcaacgtgcttttattatggtaagttgtgtttttattggtatattgattgatcgaaatcataataatttttgttctatagcggttgcatcatttattatattattgtttaatcctgaatcattgctaagcccaagttttcagatgtcctttgctgctgtacttgctcttgttgctagtcataatatttttttaagattagtagttatgaataatatagtacagtatttttcatcaattgttttgagttcgctgattgcaagtttggctacacttccttatgtagtatatcattttaactatttttctatagcaggagtttttgctaatttgcttgcaattccaattacaacattttttataatgccattgggattgttatatattgtattgggtattgtcaatttggaattttgtgtttcgtggatgctagaaagcacagtaaatttacttatatatatagttaagtatattgctaaaatagatggattagtagtattgtttcatgctttttcttcagtatctatattaattattactttaggatttttatttttgtgtttatggaaaggaaatatgagattttgtggattaatattagttatactgggattttttgttggtattagttatgtaactcctgatattatgtttaatcaacacaatattgtagttaaagagttaaatggtaaattatatgcaattaatcaaaaggctcatttgacaagttttataaatttaacatgggcaagacaaaatggtcagaagaaaatgttaaaacattattctggaaataatcaatacttatcctgtgagagagcagggtgtatatataacaaattgggaaggaatgttttgattgcttataatgctgattatgtaatgcaaaattgtcaggatgtagacttaattatacaggctaagaagtttatgtatccgagtgaatgtttaacacagcatattaattataataatactagtaagtcatatgttatttggataacaaataatgagataaagattgatgggatgtttggtaacagaatatggaatacataaggagtaatgaattaggagtagtaaattttagtgatagaatagttgccgtttacttgtaatgtatggaatatacttattcatgatttatgcattgttggtatacgagtaatgaaatgtgtcggtaatcaagttgttagtaattctactcttttcatatctctctacagttaagattgcaaattgatgggggataggaaaggataaaaaatcatggaattccgcatgattgtactgtaatttattgtgtataaaatgaattcaattttaaatgaattttagttgttatatatactaatcagaatatttattcttgatacttgttagtgatattatgttattgttaaaaaactagtttacctcgttaatagtacatccattttaatataatgaactctgctctctcagtataaaagtgtactgaaatacaagttgttcataagaagaacaaaattgataaggtatctggtggaatacgtggatttttattattaagcataatttgtttctaaacacctaataaaatgcactcttctctctcgactaagaagtgttacttgaatataagttgttacaaagcagcacaagattaataaggtatctagtgaaatatgtagatttattattaggtacactacatttttattattgagcataatttgtttctaaacacctgataaaatgaactcttctctgtcaatataaatgttacttaaatataagttgtggcaaaaaagaacaaaattgatgaagtatctggtgaaatacgtagatttattattaggtacactacatttttattattgagcataatttgtttctaaacacctggatcaaatgagctcttctctgtcaacataaaatgttacttaaatataagttgtgacataagaagaacaaaattgataaggtattttagtaaaatacgtggatttttattattaggtacattacatttttgttattaagcatgatttgtttctaaataaatcacctaataaatgaacatgtattgacaacgttcttctatattagttagttttttgttactgctacactttaaatatgtttttgtattttggtagtaatattagtatagcaatagtgttactaattaatattagtgatatggaaatgtcagctatgtcccatagaagctgcacttttcctaatgctcctattggtattattatagtgtataaaattttccacattttgataagtaaactatcttttccatctgtaagacaatataaagtgcttttagcacaaacaaaccatgtgaaaacagttgtgaatgagaagcaaaacatgattagtatgataacatagtttatgtattctgaatcgaatgcagatttaaatgcagcaatacacatgtttgtactttcaagagggccagaccatgcattagttaccagtataactagggttgtaactaatgtgacaatcactactataaatggtgaaattaaagaaatcatactttgatgtgtattgaagtttttactattactattgatagaggaatgaaccataccctctaaccctaatcctatatctgttgcaaatatacctctaaaagtgcctacttgaattatatgaaatgtttctagtatgaatgcccctatcattcctgatttaaagctatcaaaagttaggaaattagcaaacattaactttatagaaggtataatattgtcattaaatttataaagtacaaaagatgctagtattatatatgctatagccattcctggtacaagtcttgaaattaatgctgtaataatttccaaccttaatattgtaacggcaaagaacattgcacacatgaataatcctgctattattggtggtttgttaattaattccattggtattgatagagagttaacttgaacaaaattacctattgcaatagaacatatgagcatgagtatggtgaaaactatgacagctttttttgacttaaatgcatttttaaaatatatagcgggccctccaatatattgtttattgactttaacccgtgtctctatacttagataacaagttacatatttaataattgaacagagagttactatgattatcatccataaagcaaatcctgggcctcctgattttaatgcaactgctgtgcctgaaatattaccaacacctaaattcccccctattattgtgcataatgcaccaatagaaaaagacttgtcacgatacttcttcattgtgattaatgaaatcgcacttggaagttttgtaatttgtaagaatttagattttattgataagtaaataccagtaaacagcaacagaaaaactgctggaaaagataatactaaatttaatatactcatagtaattcacacacgttatacaagaaaaaacttataggaatagccagttacctaaaacttcaagacttcttaagaatataaacttggagtatttaaataactttttaatctcaatgacatttctttaaaatttacctttggtgtatacctattaccaattaatatataataatatcccttaatagcatatttaacaagaacactttgtgctaacacgcgaaaacgtcttttaactttattacgcacaacagccttaccaactttcttactgactgtaaacccaactctaacacacccatcctctaaaagaccattaggctctttggcgacctgtaaaaacaacccatttccacctacaaaggtaccattattccttgcaaataaaaaacatttccttttttttactgtgactacaccctttaagcgcatagaacacgacgaccttgagcacgcctgcgatttaaaatccttctccccatcttagttgacattcttgatctaaagccatgtctacgcttgcgtacaattctactaggctgaaaagtccccttcataccagaatttcctaataaatgtcaaaaccatgtctataagctacatggtgttgtaatatttgtcaagaaggatatttgattaatggaaataataatttgtaaatttagttcttggttgaaattgttttcaaatattaaaattacagctgtgaattcatggtgaattataaaagataaagaaagtagtcatctaatgtaatggtactataattttttttatttttgttaaagtggtagtgtgcgtatagttacgcatgttgctacttctatgtctggtcatattaggaggatgtatgttgtgtaaaataaaggatattatatctaatttcaggaaatatcatttgctattgaggttacatagtgtagaaataattttattattgatatttcctagtttagctagtatagccctagtatctcatagtgtattacgtgcttgtggttatatgtttttatgttccataggagcatttattatgagaccagctgggtgtataattaatgatatttttgatagaaaaatagattcagaggtaaaaaggacacaaaataggccattggcaaataatagtttaagtgtttttcaagcattgaaaatattagcaatacttttattgtgtgcgtgtgtattacttgtgttgactaatatgtatactattaaaattgctattgtatcaatggtattgattgttttatatccgttagctaagagatattttgcttggccacagttattgcttggaatagtctttaatactggaatattgatgggatgtactatgactgttggtcatttaacattaagttgtgtactactttatataggatgtattttttggacggtaggttatgatactatatatgctgcgcaagataaggagtatgatataaaattaggattgcaatctactgcaataaaatttggtaatgatattcgattatggattggacggctatatatgattactgttacaatgtggctttctgctggaataattgctgtgttgcatcctattttttatctagcaattctgattattgctgcaattttttattatcagtataaaaaatcagattttgacaacccagaaaaatgtatgtatatgtttaaagtaaatatatatgtagggttgattttatttttaggcactgtgtttggtagaatattataagcaatgtgaaatagtgctgtagttgtgtggtgggtaatttaaataaatgcagattggtgattggtctaaaactcatataaaatcttgtttcagtgagtttgttactggtataacagttgttactacagtgagtcaaaatggtagtatgcatggaattactgtgaattcatttaattctgtttctttagtgccgcctatggtattgttttcaattgagaaatctgcttctaggtttgaaatatttcatacatgttcaaagtttattgtgaacatattgagtgataaacagaaaagtatatctcaaaattttgcagagtgtgatgtgcaaaattgggaagattttagttatagtgttctggatggtattccaatcattaatgggatcatgtcttatatatactgtgctaagaaatatgtatatgatggtggagatcataagattatagttggtgaggtcataaattgtgcaaaactaaataatgatgataaaccattggcgtactacaaaggtaaatatatggttataggaggtgtgttatgacacgagtaaatataggtatagttggttgtttgggtaaacaagggagaaggttggttagtgaaatatcagcgagtccttatgctcaagtaagtggggggcttgttcgttcaggaaatccacatgttgggcaaattttaggagaagttgtaggatgtgattgttctgtcaaaattactgattctttggaacatctttttgaaacttcagatattgttatagaatttactaatcctgacatgttattagagtgtatcaaaatggctgaacagaagaaaaagcctttattaagtggtactactggtccagctgctacagaaatggtttttgaagattatattaagagtataccatttttatggactacaaatgtaagttttggtgttaatatacttgcaaaattggttcaagaggctgcaaagaagctgtttgattatgatattgaaatatgggagatgcatcatagatataagaaggattctccatctggtacatctttaattttaggaaaagctgcagctaagggaagaaatgttcctttccaaatggctcaatatgtgagaggtactccacaggaagctagaaaagatgtgaatactattggatattctgtatctagaggtggtgctgatttaagtgatcatagagtcatgtttgtcagtgatgaggaaatgatagactttaatcatagaacgttaaataaaaacctttatgcaaaaggagctttaaaagctgcattatggttagtcaagcaacctcctggtgtatacacaatgtcagatatgatggctgctgtagagtagttatttaattagggttaatatgtcacaacgaattcatgcttcagctagaaatttaagtttatggtatgatactaaccaaattttatatgatataaatttggatgtatataaaagagaagttacagcttttataggtccttcaggatgtggtaaatctactttcttgagatgttttaatcgtatgaatgattttatatcaaattgtaaaattaagggtagtttaaatgttgatgacataggtgtttattctgttaatacgaatgtggttcttcttcgtgcaaaagttggtatggtttttcaaaaacctaatccttttcccaagtctatatatgataatgttgcttatggtccaaaactacacgggttggctaagaataagaaaaagttagatgaaattgtagaaaaaagcttaacaagtgttggtttgtgggaagagttatgtgatagattaaaagataatgcttttgaattatctggtggacaacagcagcgcttatgtatagcgcgtgctattgcagtgaggccaactatgttacttatggatgaaccatgttctgctcttgatcctgttgctacaaatgtaattgagaatttaatacaaaacttaaagaaaaattttaccattattgtagtaactcattctatgaagcaagctaagaaaatatctgatagagtagcagtttttgattctggaagaatagttgaatataatactactcaagagatttttcaaaatccacagtcaagtaaaactcagaggtatatagtagatcagttatagtaatattttatataaccacatggtaagtttgggatttattgtatctatgaagatgtaaatggaatagcattttttactgtaatggctaatgaaagtaaggcttagaaggcttggataagatacaaaaataatagataaattatatgttaatatgaagctggattattgcatatattaggatattaaatcattcgaaaaattttttcaagacccatagtgagtaaaatgtaggaagtaatttgatagtgttaattaaggagaatttttttaattctcttaagactgagtttttattttataacccattggttttgttcttctgctagtgtattattaagtattgcttttctaatagactccattaagttattcataaaatatatattgtgtatactaattaaactgtaagctaataattcttgtgcttttaaaagatggtgtatatatcctcttgaatgattacaacatgtaaaacataagcaatctggttctatagggtttgtatctattttaaatctttcatttcgtagatttatatgttctttagtacgggtttcttcttttctgtggtttggttttactaatgccccaccgtgcctagctattcttgttgggtatacgcaatcgaaagtatcgatacctgcttttacgccttgaaagatatcatcaatattgcctattcctaataggtgaatagggcgatttttatctaggttgcttgttgttaatgaaacgatgtcatacatttgttgtttacatgctcctaatgaaccgccaattgcatgtccaaagaatggcatatcatttataaagctacagctattaatcctaagatcttcatgaattccaccttgaattatcccatataatgcttgagaataattgttattttttttaaattgatcaatgcatctgacagcccatctatgactcatattcattgaattttttgtgtaatcataactaacatggaatggagtacattcatctagtacaacaattaaatctgctcctagtttttgttgtatttgtatagatttttctggagttaggtgatatgtgctaccgtttatataggatttaaatatagctccttcctcgttaatggaaactagggtttttgaagtgtactttcttcctgcgcttttaatttcatgtgacactgaaccataccctaaactaaatatttggtatccacctgaatctgtaagcattggtttattccaaccagtaattttatgcaagcctcctaatttttcaataatgtcttcaccaggttgtaacattaggtgataagtattagataatatgatttgtgtatttgattctttaatttttgatatatcaacagattttatagctgcttttgtagcacagaatataaaggctggagtattgattataccgtgaggagtaagtatggtacctagtcgtgcgttattgtgttgatgtataattttgaagttaaaatttttgtacataagtaagtaagagattcagtagttaatgataatatttaaattattttctaaatttttgctaggtgttagttgaaaaatatttgctaatttgcgtgttttcaataataatgtaggctagtatttttaattttggagttatattaatggctgtaccaaaaagaaagaagtcaaagtcacgtcgtaatatgcaccgttcacactgtagattgaaagttcctaatattggtattgataagacaacaggggagtataaattatctcatcatgtatgcttaggtggatattataatgagaaacaggtattagaagtagatagtagtaatgtatagttaatttaattttttgggaagtatgtaaatgagcataatatcaattgcagtggatgctatgggtggagattttgctcctgaagcagtagtaagcgggttggattttgctttaacaaatttattagatgaccaaaatgtttcttttaatatatacgggcagggaagccaagtgttgcctatattagataaatataaggatttaaaagaacatagtgtatttattgatactccagaagtagtattagcaaatgataaaccatcctttgcgctaagaaaacgtcgatcttctagtatgtggtgtgcaattgatagtataaaaagtggtgtaacctctggagttgtatcttctggtaacacaggtgctttaatggctatttcacgttttttgttgggaacacttcctaacatagatcgtccagcgatttgtactgctcttccttctagaggtgaggagtattttgtattattagatttgggtgcaaatattgaaagcagttcaaatgctttatttcaatttgctattatggggagtgcttttgcaaaagctgtgttgaatattgctagccctaaagtagcattactaaatgttggccaagaagaagttaaaggcacagatgttatcagagaagcatttttattattgaaacaagctgaaggtaggataaatttttgtgggtatattgaacctattgatatactaggagataaagttgatgttgtagttactgatggattttgtgggaatattgtattaaaggtagctgagtctattgcatatacttttaagtcagtttttgaaaagtccgttactagttctataatatcaaaatttgcaggattattgctaaaatcccagatgaaaaaagattttatgaggtttaatcctaaaatgtataatggggctatgttattaggtctaaatggtgttgtggtgaaaagtcatggaaatgctgataaggtagcttttgctcatgctattaaagtgactgtaaatgctgtgcgtaatgatatcaatgctaaaattattcatgaattaagttaatgttattctatgaaaagatctactatactgggaataggctcatatttgcctaaaaaaatagtaacaaatgatgaacttgctttaactgttgaaactagtgatgagtggatagtaaaaaggactggtataaagcaaaggcatattgctgagaataatgaaatgacatcagatatggcagcaaatgcagcaaggttagctttgactgatgcttgtgttcataaggatgacattgggttaatcattgttgctactactactccagatagaacttttcctagttgtgctactatagtgcaagataaattagaatgtaaaaatgcatttgctttcgatattcaagcagtatgttctgggtttgtatatgcaatatctattgctgataattttattaaatctggtcaggtaaatacagctttagttataggggctgaaattatgtctagaattttagattggcaagacagatcaacgtgtgttttatttggtgatggagcaggtgcagtagttttaggtaacaattctgaaaaggatagtggtattatatcaactattttacattctgatggagctttttgtgatttattgtataccactggtggtactgcatataatggtcatgctgggacaatctgtatgaatggtactattgtatttgaacatgcaattgaaaaattgagcgcttctatacttgaaattttagaccaaaatgatttagaaataaatgatgttgattggtttgttttacatcaggctaatatccgtattattgaattggtagcacgtagactgaaaataccttatgaaaaaatggttgttagtgttaattggcacggtaatacttctgcagcatcaattcctttagcgctatcttatgcaaagagttctggaaagttaaagaaacacgatattgctatattggcagcaataggtggtggttttacttggggaacatgtttagtacgtatttagctgttagattgtattaaaaacagtgatgtatttttgattagtggaaattaagttatctataaattactcttttcttagttttttaaaaaaatctgttataagttttgtattttctgcttctaatattccaccatatacttctgggacatgatggcaaaattgaaaaattctagctccattttcaattgctccatattttttgttgtaagctccaaaatataatctacgtatcttagaaaatgatattgcttgtgcacacattgcacatggttctaaggttacatatatatcacattggtttaatatatgagtagataatattttacatgcatttcgtatagctaaaatttctgcatgagcagttggatctatatcatgtatgtttgagttattagcagaagatattacttcattgttatgtactataactgctcctacaggtacttctagcagatcttcttgtgcttttgatatagctaatttcatgtatgtatagttaaacactgttttattttttagttaaaggagtattatataatagaaaggagttgattagtatttatatattttgataaagggggtggttaccattgtggtaaaattgtgatataatatacacgtagagtttttatatatttttatgtattttgatattcttatttatttagtcctagctttaggtattttaggcatttgtattgctttatttaccttctataaaagttatatacgtgagagtatttttaaaatatttgttgataatgattatgatgaagatcaactaacagatgaagagaaatataaaaggtatatagagaaaaaacaaaaagagcttataaaacatcagatgttaataaatgatgttgctagagatcaagtagagtataaaagtaatattaaaattattaatgttatggagccaataggccagtggactaagcttgtgatgtcagagaaattacaaaggtttgctggattgaagtttgataaagagcaaacaggcttttggcaaatgtttgttagtatgagatccttatctcaaggaaagtataggggaagatctaaatagttaatcagtactttctctttataaaatctaaaagtaacgataaatctacatatcgataatagttgttataatacatatgttgtgtgatattataagtctgataaataaggttgtttaattattatattgagaaagtttgtacactatcatacttgtaagtgttgatatataagtagcatttatatgttatcaaatgtaagatttcatttttttaaatatatgagtaatgaagcatagtaatttttagtatgtttatcaagcaataaattatagagaaattttattcatgaagttgtgctataaataaaactctaattattacaagaatttaatgtattcttattgttgctaaataagtgtgttagagaagaaattgtaatgtgaagttggaaatatattaattgggtttttttaagttgttagtgactgtaagatgttataaatagttataatcgagtttttatctaaattgtagtaatgttattttgagagggtattttggaattaaaatcaaacactagtaagaattttggccaattaatgtctgagcttccctgtaatattgaagctgagcaaatactattgggttcaatgttgcgtgataatagaatttgtgatgcggttgaagatataataacaagtgatgtgttttttgatagtcttcataggcgtatttttgaacaaatagtaaaaattaataagcgtggattggtcgctaatgaagttagcttaaaaatgttttttgataatgatgaagatttaattgaatctggtggagttgactatttagcaaaaattgcagcaaaagctagtattatttttgatattaagaatgttgcaaatatagttgttgatacttatttgaggagatgcctgatttcatttgggcaagatttaattagtggtgcatataattatgatgttgataattctgcagtttatcaaatagaaagtgctgcgcaaaagttattcttacttggcaatcaaggaaaatctgataaaacttatcatcaatttgcacttttagttgcaaatattaagaaaagaatagaatttgcaaaaaataatgaagggacattgcaaggtgtgtctgtagggtttcgtgatttagatcagctgctaaatggattacagaagtctgatttacttattttagctgcacgtccatctatgggtaagacagctttagcactaaatatggcattaaatgcatgtaaaattttaagtaatagtagtcagtacaatgggcaacatattggttttttttcattagaaatgtcagcggagcagttggcttctagggtaatagcaattgaatcagatgtaagttcttataaagcattatctggaaaaattagtggggaagaacttaaaaaagtacttgatgctagtacgaaggtatgtaatttgccgttaattattgatgattcatctagtatttctataagtagcttaagaactagaattcgtaggatgcatcagctgtataatttggaagctgtttttatagattacttgcaattagtcaagggtacgactaaacgcagtggggaaaatagagttcaggaggtatcagaagttacacaagggttaaaagctattgcaaaagaattaaatataccggttgtagccttatctcaattatcaaggttagttgagcagcgtgatgataaaaagcctcagttatcggatttaagggattctggtagtatagaacaggatgctgatgttgtaatgtttttatatagagaagaatactatgaacttagaaaacagccatctgaaggtacagctaaacatgttgaatggcaagaaaggatgaattcaataagtaatgttgcagatatattgatttcaaaacagcgtaatggtccaattggaaatattaaattattttttgaagcagaaaaaggtagatttagggattacacagcaaaatataatcctgcagattttaatttttaaaattcgtttttttatactgtggctttctagatagagatcactgtataaaatgagtaggtttatttttgcaaatagtagtagtagtgatcttacgtacaagatatacgttgaaattttgctataataaatagaaatatatgtgtgagatatttttaaaggaatttctacagtatgaaacagtttaatacattattggtcttgtatactaaaatgtgtagaaattttcctaataacaaaaactatgtaattcattctcaatgaaaatatttgatcaaatgttcacctatacactggatatgtaatgtagtaagtgtctaacttactataaatgatgattatttgtatatggtgaaatattcaaaattgtatgattgtaattttttatagtgaaaggtaggagagagttcaattagtgtatttaatatgtggtgtgttttacttttaaataagtgatttgtgagtgtagtttaatgtttagatattagtttttataataaagtacttttttgtgtaggatttcatggtaattttttataatgaaaggtaggagagagttcaattagtatatttaagatatagtgtagttttacttttaaataagtgatttgtaagtgtagtttaatgtttagatattagtttttataataaagtactttttatataggatttcatggtaattttttatcatgaaaaatacaagagagtttgtattagtatattaagatgtagtgtggttttacttttgaaaaagtgatttgtaggtggagtttggtgtttaaatattagttttaatgtaatgaagtactttttatgtaggatttcatgtttttattaagatgcttttaaggtatgaaatgagaaattatgttactataaagattattgtttggaaattttatactagatttgatcatgaataaaaaagcaggggttgtaggcgcaggattagtaggtagattattagcgttaaggctattacatgatggttggcaagttactttgtttgataaatttggtaaaaatgatagacgaagttgtggtgctattgctgcaggtatgcttgctttatattcagaatcagaaaaaatggagcaaatagtttttgatttaggtataaagtcattaaatttgtggccaaaaattctcaatagtatgttgggtaatacttcttttaagatgcttggcagtatagtagtagctcacagaaatgacatgtcagaccttgaaagaatgatgatgcttataaaaagaaaatcacatgttagtaatttagagataatagatgagaatgctttaaaaatatttgaacctgatctctcttttccttatggattatatataccaggagaggcacaaattgatagctctcagctcttttataatataatgcgtactttagaacaatataatgttacttggtatgaacatgttgttgttgataaaattatagatgaaattgtggttatagaaagtggtaaagaatataggtttgattttgtttttgattgtcgaggtataggagcaaaaagtgatttgcctaatataagaggggtgagaggtgaagtattgttattacatgctccacaagttaatttaaacagaccaattagaatggtgcatcccaggtatagtatatatatagttcctagacagaattttcaatttgttattggagctactgaaatagaaagttgtgatatgtctgaagtttcagtacaatctgtactagagttactatctgctgcttattcagtgcataagggttttgctgaagcaagaattatagatatgtcagtgaattgtagagcagccttttctgataatttacctaaaatatatgttcataataatcttattaggattaatggtctgtataggcatgggtatttattagctccgtcgttgatagaagaagtagtattgttgcttaatggaaacttgaatactcattcctcaattattgaaatggttagctaatatagagtaataatgattttgttttaggtagtcatattctgataatttacctagaatatatgttcataataatcttattaggattaatatctgtattggcataggtatttttattagctccatcgttgtagaagaaatagtattgttgcttaatggaaatttgaatactcattcctcaattattgaaatggttagctagtatagagtaataatgattttgttttaggtagtcatattctgatagtttacctaaaatatatgttcataataatcttatcaggattaatggtctgtattggcataggtatttttattagctccgtcgttgtagaagaaatagtgttgttgcttaatggaaatttgaatactcattcttcaattattgaaatggttagctagtatagagtaataatgattttgttttatagatgatcatatacttatggtttatgattcttagttaaatgtggattatggtgttaataattttttagagtgtcattagatagtgtgttaattattttaatgttatttctgtgcttttcaaaaaggtaagcaaaaagctatattatatctgatctttatgttaataatccacaattttatataagaagagtttgatttttaatagtcactttatgtgatgtatagttctaatagtttttggaaatattattcaataatgttcatatcaattattttaatactattttcatcaaaattttcaggtttttcgaaattagtaaaaagtttaggagatacaatcatggatcgtgtcatatctgatctcatattaatgagtcctaactctatcgcaagaggagcttcatttttgccaatttctacttttaattcttgatcttctagtaatacttttccatttgattctcgtactgtatattttacgcttacactatctccacagtgtatcttattgacagtaccttcataattttcaatagtattgttaaaaattaatatatcattgacttcatctggatatgatgaattaatggatattaatttaacatagtattgttcttttaagttgccttcttggtctgttagtataataatacgttcaccttcttcttccatacctgctattgtataatttagttcttttataatactttctcctaatttaaatgttacttcctgtggaatattttttaatgcttgagaaaggatgtttttgctttctgaatcatataggaatttatgtattattgcggaaatattttgtccacatagtgcttttttaccatttccttctacaatatcgtgtattttaaagagatctggttttatagttttatgtttaatgtgctcaaggtaatcaactaatccatttatttttatgtagtaatcaatacgagattcaatgattggtcttaataaatcatatcctataatgtgtgtcagagaatgattaacattaattttgtatggtttattagaaagatttgtatgttggttgagtgttgtttttgtgtataatattgttaatgcttttcctacaagtgttatagctactatggtaagacagacatataataatctataaaatattttcttcatgtttttttataaatttcttataaactcagctaaactgtgtaggatatctgctttatgtgaaagaatagttaaatgttcgatagatttgtctatcaagctattaagatagttttgagcatcttcgttatttaatatattgaggatgttgttttttgatttatcctgatttgcgtcagcaatgtcatcttttacttgaaaagcatgtccaaggtttaatccgtagttagctagagcatttaattcaatatttgatgcattccctaatattcctcctaattcacatgctacagagaaaaattgggctgttttcaacacgtggatggcttgtatatcatttgtgtcttttgctatagtttctgtatcaagtatttgtccttgtatcatgccttgataacctaaagctttagctaatgcttttatcatacagcaacgtataaatggtgattcatcaattgttgataatatttcaaatgctagagttaatagtgcgtcaccagttaatattgcaattgcttcgttaaattttttgtgggaacttgcttgtcctcgacgtatgttttcgttatctatacctggtaaatcatcatgtattaatgaataaacatgtataatttctacagctgcactgacaggtagaattctatctacattaacgttgaatatttgggcagaagcattaacgagaaaaggacgtatatgcttgccaggtgcaaacatagaatacctcatggatgttaataatatatcttgattattttctggtagaatactttctagttgtttgacgagtaagctactatgatgtttcattaaatctgatatattgcagtacaaatttccctctatatgttgtttcctttgtatcaaagattataaaagtctgagaataatatgcaatgtaatttatagtggttgttataaaagatttatattatcttttatttaattttttagctattttgtcatttcttttaatagatattttatataatgaacatattttagtatgtatatttacataataagtaaattgctgagaataatgtttgactatgctgatattcacttttataatcagctggcatgactccttcgtctagtggtctaggaccccaccctttcacggtggtaacgcgggttcgactcccgtgggagtcacttttgttctttcttttgtatttttcgtagttttaaataaaaacttgctttcctattgggggcatttgttatattaatcacaattattagatgattttgcagtacaattttttttaatagatgttttgcatttctatatattgtgctttatatagtaaatatatacaatatgtatgcgtgagcaataattcctattatgcatagggtttgaataataagaaaggtagagattatggggacagtaattgttgattatgaaagagataataatcttacagcttttggcaaagctgtattgtctgataggtatttacttgaaaatgaagattatcaacaactgtttgtaagaatttctgaatattattcagacaatccagaacatgcacaaaggttgtatgattatatgagtcaactatggtttatgcctgctactcctatactaagtaatggtggtacaaatagagggttgccagtttcatgttttctcaatgaaacagaagatagtttaagaggtattgttaatttatggaatgaaaatgtatggttggcatctaagggtggtggaataggaagttattggggaaatttgcgttctataggtgaaaaagtacgtggtagtggtaaaacttctggtattataccgtttattgtagtccaaaatgctttaactttggcaattagtcaaggatcattacgtcggggtagttctgctgtatatttgcctgtttggcatccagagattgaagaattcttagatttaagaaaaccaacaggtggtgaccctaatagaaaagcattaaatatacatcatggggttgtattatcaaataaattcatgaaatgtgtagaaaatgatgaaccatgggatttgatcagccctaaagatcagtcggtactttttactataaaagcacgtgatatatggataaaaattttgacaacaagagttgaaacaggtgagccatatatattatttattgaccaagttgataacaataaacctgaaatttataaaagactgaatttagacataaaaatgtctaatttatgtacagaaataactctcactactggatatgatcatttaaataagtcacgtactgctatatgttgtcttgcatcattgaatcttgaatattatgaacaatggaaggacaattcgttgtttattgaagatgttatgaggtttcttgataatgtgctaactgattttatagaaaaagctcctagtgaaatggaaagagcaaaatattctgcgatgcgtgaacgtagtataggagttggagtgatggggttccattcatttttgcaaagtaaaatgataccctttgaatctgtagcagctacaatatggaataaaaagatattttctcatataagaaaacatgcagatgctgcgtcttataatattgctatggaaaaaggttcttgtcttgatgcacaagatgctggtattgtagagaggtttgtaaataagttatctattgctcctactgcatcaatttctattattgctggaaatacttctcctggtattgaaccatatgcagcaaatgtttttacacataaaactttaactggttcttttattgtaagaaataagtttttgcaaaaattgttaaagctaaaaggtaaagataatgaacaggtatggtcttctatatcaactaatgagggatctgtacagcatttggattttttaactgaagaagaaaaattaatatttaaaactgcatatgaacttgatcaaaggtggataattgagcatacaagcgatagatcaaaatatatatgccaggcacaatctgtaaatatttttcttcctgctaatgttcacaaaaggtatttgcataaaatacattttcttgcttggaggaaaggattgaaaagtttgtattactgtagatcaaaatcaatccaacgtgcagataaagtatctcatggggcattagaaaaatcaattgaacaatataagcaaattacaaactttgattataatgagtgtttatcttgtcagtagtagatcttattattaagtaattactgttcttcattatttgcagttagtatactgctgctatatcatactgagcgtttattttactagtgcatgttataaatgaaaagttagtgtttcatatttatgatgattagcttaaaaaattaagtgtattattatagttcatttttatggatgtatgaaagtttaagaaatttctatctttttattaaagcatatcaataatattgggtcataattagtttgttatatgttcaggtaatgtttagcaatatgtgtactgacgcgtaatattttagaatgaatggaagtggtatgttatataaaagtattgatgaatttataaaggttatatagataagacaaaaagatgatcagcttaaaaaattaagtgcgttattatagttcatttttatggatgtatgaaagtttaagaaatttctatctttttactaaagtatatcaatgatatcgggtcataattggtttattatatgttgcggtaatgtttagcaatatatgtactgacgcgtaatattttagaatgaatggaagtggtatgttatataaaagtattgatgaatttataaaggttatatagataagacaaaaagatgatcagcttaaaaaattaagtgcgttattatagttcatttttatggatgtatgaaagtttaagaaatttctatctttttactaaagcatatcaataatattgggtcataattagtttgttatatgttcaggtaatgtttagcaatatatgtactgacgcgtaatattttagaatgaatggaagtggtatgttgtataaaagtattgatgaatttataaaggttatatagataagacaaaaagatgatcagcttaaaaaattaagtgcgttattatagttcatttttatggatgtatgaaagtttaagaaatttctatctttttactaaagtatatcaataatatcgggtcataattggtttgttatatgttgcggtaatgtttagcaatatatgtactgacgcataatattctagaatgaatggaagtggtatgttgtataaaaatgttgatgaatttataaaggttatagataagacaaaaagaataatgggtttagattttggagagaaaaagatagggatagcgttaagtgatagaacaaatttaatagcaataccttacagtgtgtatgttagaagaagcagtagaaaagatttaggtagcttatatagtatttttgtagagaatgatgtagggtcgatagttataggttggccgcttgaattgagtggtgtagaaaacgaattgtgtcagaaggtagtgatgtttgcaaatcggattataacaagatataaaattaatatttgtttacatgatgagaggtatagcactgctatggctacaaggctagcaaaattagctaatattaaaagaaaagaatctcaagcaattgatgataaaatttcagctgtattaattttacaacaagtgcttgatataataaaagtttatcaaatgtagaaaagtagtatcaatattttacaggtggatattgtaaatgtggtgaccactctattagagatgatgctgtatacctatatataggatataaggtaataagagtattataatgatcaatagtaatgaatatacttaaatttctgctttataatctgttttataacatgataaattttctgttataagaatggatatattagattttaatcacttatttccacatcaataatttaagtgacagtattattttagtaagagtgactattataattctttttaatttgcagaatgtacatttgtaataattcacattttttactacgtgttttaggtattaattgaatatgattttaatattttcttgtttttaaagtattttatgaagtgaaattgtatagtagggctcttatatggacaatttaaggtaatatagcatgactttttcttgtgttcttatgatctacggtcaaataaaacttaagtatctttaagtatatatgctattgtagaaaatcattgttgagtataatcatagaatttctttctgggcctgtagaaatcaaatgaatagggacttttaggatttcttctattttctttatgtacaatatagcgttttgtggtaaatccttatacgatacactgccaaatgtgcttgtttgccatccaggaagtatttcatatattggttctaaattactttgtatgtgaggtgaagcagggaggtaatcgtatgttttatctccgtatttatattttacacatatctttatttcactgaattgatctagtacatcgagcttagtcataactaatcctgatactccagatagcattattgcttgtcgtgctagtactgcatcaaaccatccacatcttcttttcctattactgacagttcctaattcttttcctgttttaaacatgatttttcctatatcattgttttgttcagtaaaaaatggaccattacctactcttgttgtataggcttttactaatcccagtatgtaagacttattagatggattgataccacatccgacccatgcttgtgatgctatggtattacttgatgtaacaaaaggatatgttccatggtcaatatctaggaatgttccttgtgctccctcaaaaattattgtcttattttgttgtgttaaattatatatggttttccatactggttgtacgaatggtaaaatttttggggcaatattcaacagttcattaactatatcctctgcctttataggtggggtattaagactttttcttaatagattatggtagattagaagatgattaactttgctgtatagcagatcttttgtatctagtaaatcacatactctgatagctcttctgctgattttatctgcataacatgggccaattcctttgtttgtggttcctatagtatcttgtctaagttgttcaaacagtatatctgcttgtttgtgtacactaagcactagtggacaagattctgatattgcaagattttgagtagtaatgttaataccactgcttttcaagttatcaatttctgaaacaagtgcataagggtccaaaactactccatttcctattatggacagtttattgttttgtaaaacagaagatggaagaaggtttaacttatatactttatcatttatgactatagtatgtcctgcattattgcctccttgaaatctcacgacagcgtctgcattagtggatagccaatctacgacttttccttttccttcatcaccccattgtaaccctacaactactatatttaccatagcttttctgtataaatcccaagccacactaacaaaataaagaaattgtgtcaaatgatttagtagtcatagtgtcctatgtgtatagtatcaacccagaaacctggtattggatttcaatgttgagaaattatgtatgtaatattttaatcaatacatagcttatatgtataaggctttttgtatgggataaacaataatacattactttttacatactgaaaacatatgtagaaagtaatgcatattgttaaaaatttgtagattgaaatgacaactgtttatgaaaaatcatttcaattatctatcattgttctgttttattagaggacggatccttgtctgaagatttagctttatatataagattatcagtaagtgttatcacaactctacgatttttagtatgagcgtattcagcttcttctggattgttagagtacactaaaactgctggttcagactttcctttagattctataataattctatcctctaaagacttattacgctctagaatgaaatctttaacagcatttgcacgctgtttgcctaattctaaattatattcatctgttcctctagtgtcggtatgtccaacaataatgatattagtatcaggatactcttctgccttttgcataactttttcaagtattgttttatcagaatcctcgattgttgcctttccaaaaccgaagtatattttttcaatagtcttcgtattagaaaacacatgatcaacatttaccaatggaacatgatcagtagttttacagctacttaaaattaagcatagtagcatgaatttaataaataccaacttatgtttcatagtgcctcaattgttttaaacaagattatcatgatcattgcttaaaattatcttaagtcaagagaaaaatcaaattgtagctatattactggatttatacaataatttactctagttagaaattgataattttgatgttattaaaaagcaaatattatgagatatacaagtattttatatacaaattatgttgtaaaattcagtatctgagttattgcacgttcattgttttttttattttctagtaattcttttatttcaagaaaagtggttgattttaaaacgttaaaaaggatttaacatgaaatttgttatgataaatctgtaatttatcaatagtaaaaaacgtgcattcaagttattttgtgagagtgtttaaatgtttttataatgttgatgtagtgtatagcgtagtgcttaatgcaaaggttgtgtaatcaatgactgtatttattgtcttggtttaatagaatttatttaaattttttagacagagaaatattgatattttgtgttgtattgcgctaatataatcaattatcattatcaactatattattggaaattgtgtgatgattttctgtatcaatatttttgtattaatgttttacctggtgtagtgtatattggtatgcgttgtgtgattagtatattttagaaaagttctagcatgcttattgatattatttaaatgaatttttgattaactgactaagtgaatttaacctacggaatattatacatatgaaacattataaatttttggagcaagtttttggtaaaattggaaatattaattctattattaatgttttagaaactagtgaaggtaatttttgcgataaaatagagcacatttgtacccttaaagaaattaagcatgagattcttaatagtgagatgatcggcgatatgatacaacattctgtagctaataaagcacaattaaatgactgggaaattgctaacttgaaccatattgagctgatacataagaatagtagtgcagttcctgtggagttggtattagacctttatagagcgcaagttaagtgtaaaaattcttgggtattattccgtaatggtgatgcttctatacaagatatagttgctttattgtctgatgttgtaagattggtaagtgatattgcttctattaaagctgagagtttaaagatttctaaatatgatgttattttaggactacaagatagtaaattgaatacaagaaaagtagatgctatatttactgaaataggagcttttttccgtcagtttatcactgaggtgggtgataagcagaaacacaataagatttgttatccaaaaggtattaatgaagagaaacagatacttctaggttatgatgctttgtcgagttttggtatgacaaacagtaatattattaatagtgattatgtaaataatagatattcatttgggaaagatttaccttttttagttaattatagtgaagatgattacagaatcgggttaaaaactttattcagaaaaataggttatgctttgtatgctttgaatttacctgagaagtggcataaacaacctgtagggtggaacttaaataacattctatctgaaattttggggctgttaacatcgaatcacttaatgatgagtaaggagtttgtaaagtttatatctcctaatttaaagaagcgattttcttttagaggtaaggttgggcactatgagaatattcagttatattttaacgaagtgcaacctaatttgttgatgcataaatctgatgaggtgactctactagctcatattatgctgcggtatactttggaaaaggaaatgataagtgattctttgcaagtacaagacttgccagatgcttggattcaaggaatgaaacactattttaatgttgctccaaagaatgatttggaagggtttttacaagatgattattgggtgagtggtatttttggatattttccttgttgtatgatttctgctattattgcttctcagattttttctactatgaagaatactgatgttcaagtgttgtcacaagtagaaaagggggatttatcatcatttatcctgtggataaataagaatgtatgtgattacagtacgaagtacagtagcatggatttgttaaaaaaagttacaggtcagaaattgaatgttaatttctataaaaattatcttacaaataagtatctcaacatgtagatcgttgtatgtgtttagctaaagctatgtattgttaatttaatgagaatgaaatatggacaacgaatataatgatatggtaaatatggctaatgccattagggtgttatcagtagatgctatacagaaagctgcgtctggacatccaggtatgcctcttggaatggcagatgttgctacagtattgtttgcaaagtttttaaaatttaatcctaaagatcctaattggtttgatagagatagatttgtgttatcaaatggccatggatctatgttgctgtattccatattatattttttaggatgtttagatatagaagaaataaaaagatttagacaaattcattctttaactcctggacacccagaatatggatacactcctggagtagatgctactactggcccattaggtcagggtttagcgtgtgcagtaggtatggcaatagcagaaaaaatattgtctgaaaaatttggcagtgaaattgtaaatcatactacttatgttatggttggtgatggatgccttatggaaggcattagtcatgaagcagcatctttggcaggacatttgcagttgaataaattgatagtattatttgatgacaataatatttcaatagatggtccaatttctttatctgtttcagatgatgttaaagctaggtttttgtcttatcagtgggatgtttttgaaatagatgggcatgattttggtcagattgaatcttcaattaaaaatgctcagaaatctgaaaaaccttctttgatttgttgtaagacggttattggaaagcatctttcttcaaaagaaaatacatgtgctgcacatagttggccattttcagaagaagaagtaatgttgatgaaagagaaattaaattggcaatgtaatccatttaatataccagaagaaattttgcagttatggaagaatgtttctagtagatcagaagatgaatacaacatgtggcttgataggtctgcgaaatatagtaaaacttttgatgattttgtagatatgatgaaggaaggtgttcctgattcagtttttttaggtttgaaagaatttaaaaaagaactttatgctttaaacttaagtgaagcaactcgtaggacttctggtagagtattagaagttatagcaaagcatacaagtaaattaataggtggatctgctgatcttactaattctaataatactaaaccacagttaatatcaattattaacagaagtaattttaatggatcttatttgcattatggtattagagaacatgctatggcagggtgtatgaatggtatggcattgcatggtggaatgattccttatggtggaacatttttagttttttctgattattgtagaccagctattagattgtctgcattgatgaaaaaacaagttatttatgttatgacacatgattctattggagtaggagaggatgggccaactcatcaacctatagagcacttatcatctttacgatcgatccctaatttatatgtttttagaccagctgatgctattgaagtattagaatgttgggaaattgcattaaagttaactagttctccatctgtgtttatactatctagacaaaatgttggcagtgttcgcagtgtatctgttgatgagaatttatctaataaaggtgcatatgttatacgtgaatatgagaaggatttagatgttaccatttttgccacagggtctgaagtggagattgcactaaaagcatctgatattttgaaaagtaaagggttaggtacaagagtagtatctattccttgctgggagttgtttgttcagcaagataaaaagtatatattcaatttattgaataataaaagcattaaagctgcggtagaagctgcaagttcttttggatggcatagatacataggagaaaatggtatttttgtaggtttagaggattttgggatatctgctccatataaggatttatataaacattttggaatcactgcggaaggtttagtaaacaagatacttgataagttgaaaattaatacaaattagatgaatataagtaatcaattttattaaatatttgtaaacgaaatttttaagcattgtagaacaaactttaattggtttaatctattttttagtattgaattataatgtagaattcacagagctttagcaattatattgctatgtttaatttatccagttttgagtgtaaaaatctttaaaaattatgttgttataataaaaaatacattttcttaaaaaatatagatgtatgtttttaagtctctaagtattaatgtatgtgttttacgatttaatctaagttttagttactataatttaaatgtttgtgtattaataatatttgtatatattgattttatcattgttatcgttggatgaaatgttagtatttacagcttgtgtgttattattttgtatggggatgatgttggtatatttggttactagtaaaaccatatatgataaaatacttgctgcaaatttgtttggaacgtattctatagttttaattgttgttatcggaatcataaatgatacattttctttattgatagatgtgtctttagtatatgcgtgtattaattttatttctactattgggtttatgaggttttttcttcatggttcttttggagatataaaaaaatgatggaatatataagtatagtagtgctagcattgggaatatttctagttattacttctgtagtaggagtaatgagatttcctgatttttatacaaaattacatcctgcaggtataacagattctttaggagcacctttaattttaattggacttgctatgcgatctgggttttcaatttttacaattaaagttttgttattaatctgttttttatggattactggtactacggcatcttatgcattagcacgttctgcttattacaaagagaaaaaaggtaaagatgatgctgactgatgtgaattttattataaatgttattttatctttatttttagtattcgtgtcatcttgtttggtattatttaaaagtcttactgtgaatgtgataatgatgtgtatatttagctttttgatggcattgttgcatttagtaatggatgctccagatgttgcaattacagaagctgctgtaggggcagggataagtactatactaatgttggttgctttatcattaattgatacagatgagaaacaaacgtgtggtaatataaaaatatttcctattattgttgtattaggagtgtttgtaagtttgatgtatgtaatacctgatttacctgtttttggtgatgctaattcttttgcaaataatcacgttgcatcttactatgtaaaaaacacttactcttatatgggaattcctaatatagttactgcaattttagcaagttttcgaggatatgatacttttggtgaaacggttgtaatatttactgcttctttgggaatttctttattgcttgctaaggataatcatcatgtttaaagatccagtgttgcgaacagtatctattttaatgatacctgttataattttgtatggattgtatattcaatttcatggtgactatagtccaggtggtggttttcaggctggtgttattgttgcatctgcaattattttacatggtatattatttggattaaaggtcactttaaaagtgatatcaccctatattgtcagattaattggtggtattggtattttgatatatggaggtactggtattgcatctatgttacttggtggtgaatttctctcgtattctactttggctagtgatccagtattgggacaaaagttagggatatttcttgtagaactaggtgtgggcatgactgtgtgtagttctatgttgactattttttttaattttgtatcttcttataaagaataaatgtgttttctaatagttttatttattttaactctggtatatgattttgagttgttttaattacattgtgtctataatattgatggttataggtttgtatgttactactgctaataaaaatcttgtaaaaaaattaatagggttaaatatatttcaaacttctgtattgttattttatatttctattggttatgttagtgatggtaatgtaccaattttaaatgataaagtaatattgtatactaaccctttacctagtgttttgatgttgacagccattgttgttggggttgcaattttagctgttggtttgtcaataattgtaaaaataagaagagcattttcttcaataaacaataaggaaatacgtagataaacaaatagttaatgttttatttgtttatattttttgagtgtagataaaataaggtgtttttatttttgaaatcttgtctatactattataattaaaggctatagttaagtgagttttaggtgtaagtctagtgtcaaatcataataaaaggatattaattgatgcagtatatcaagatggaattagagtagcagtattacgtgatggacaggttgtagagtttgatcaagaatcaaagaataaaaagtgtttaaaaggaaatgtatattgtgctgtagtgaaacgtatagaaccatctttacaagcagtatttattgaatatggagcaaataaacacgggtttttgcctttttctgaaatatcattagattattataatatttctgaagaagagaaagaaaaattatatcaagtattatatgaagattctgatgtaaaaaatgatgatgatgtaaaatctgtagatgactctgttgcatgtgatactaaggatcaagataatgttagtgattgtaatgacaagttgacattattgaagaaagataatttgcgaaatggtaagtctaaattacctttttacaaattgtataaagtgcaagatgtaataaagcttgatcaaaaattaatggcgcaaattgtaaaagaggagcgtggaaataaaggagcaactttttcaacatttattaccctggttggtagatattgtatatttatgccaaattctggtaataagaatagtggaatatcgcgtcgtattgaagatgctgatgatagaaaaattttaaagaattttctaagtgctataaaactgccgaaagaatcaggaataattattagaactgctgggtctaataagaaccagaaagaaatagagcaggatttatcttatttacagtcgacttggcgaagtatacagaatagttatataagtgttactatgcctttattgttatatgttgaaggtgatataataaaaagaacattacgggattattgtgatgagaatacgcaagatattattgtatcaggtagctacgcatatgagttagcaaaagaatgtgttaagttcatgtttaggaacagggtgcgtcttagaatttataagggcagtgttcctattttctcttattacaaaattgagtcgcaaatttgtgaactatatggaaatgtagttaatttgccttctggaggatatatggttattactccaacagaagcgttggtatcaatagatattaattctggtaagatgacaggagaggatagtattgaggagacagcttataaaacaaatatggaagctgtaaaggaaatagctagacaagtaaacctgcgagggttatctggattaatagtgatagattttattgatatgttaaaatatcgctattgtaggtcagttgaatctgaaattaaagaagcttttaaatatgataaagcaaaagtacagtttggctatataagtacatttggtttgatggaaatatcaagacagagggtcaagcaaagtatattagaagcgaatacggtacaatgttcacattgtaaaggagtaggtagggttaggtctttggaatcttcttctggagatatattacgtgatattagatattgtgctaataagaatcgtaataaattgatcaacatttctgttgctggacaaatggtagagtatttttttaataataaacgtcaacatattgctgagattgaagaagaattcagtgtgtcagttaagttaactgtgaatcaaaatacgagtagtgtatctgattttaatattagtgttgaaaatgatgatatgttaaatcaaggtaaggatgctgttaatgtatttactgttgattataaaatttctgaagataataaattaaaagaggaaatacaaaaaactcctactggaaacatgtggataaagaagtggttgacccgcatattttcacatatttaattcataaatttatgaacttgtgttaaatggggttgtaatcttatgatttggttattatatctgtgattatagttttgatttttatgtaagggggctatttatggctgttataggtatagatttaggtacgacaaattcttgtgttgcagttatggagggaggtgatgcaaaagctattgaaaatagtgaaggggctagaactacaccttcaatagttgcatttactgattcagaaaggttagttggggatccagcaaaacgtcaagctactacaaacgctaagaatactatatatgctagtaaaaggcttataggacgtagatatcaagatgtgaaagatataaaatcatcttatgatgtggtgtctgctaaaaacggtgatgcttggataaaagtacttggcaaagaatattctccaagtcagattggtgcatttgttttggaaaaaatgaaagaaacagcagaaagacatcttggacataaagttgagaaggctgtgattacagtacctgcatattttaatgatgcgcaacgtcaagcaacaaaggatgcaggaaggatagcaggattagatgttattagaataattaatgaacctacagctgctgctttggcgtatgggttaaataaaagtgataaacaaaaagtaatagcagtctatgatttaggtggtggtacttttgatgtttcaatattagaaattgctgacggtgtttttgaagtaaaagcaacaaatggtgatacaatgcttggtggtgaagattttgaccacgctattatgaactatttgatggatgattttaaaaagactacaggcatagatttacataatgattctatggcagtacagagaattaaggaagcatcagaaaaggcaaagatagaattgtctaaccgtatggaaactgatataaatctgccatttatttctagtgatagtactgggcctaagcatttaagtttaaaattgactagagcaaagtttgaaaatttagttgatgatctaattcaaagaactattgaaccatgtaagaaggctcttaaggatgctggaatatctgcagataaaatagatgaggttgtattagttggtgggatgactagggttcctaaagtaatacaaaaggtaaaagaattttttggtagagaacctcataagggtgttaatccagatgaagttgtagctataggtgctgctatacagggaagtattcttgctggtgatgttagagatgtattattattagatgtaactccactatctttaggtatagaaactttaggtggtgtatttactccattgattgaaaggaatactacaattcctacaaagaaatctcaagtattctcaacagcagaagatggtcaaactgcagttactattaaggtgtaccaaggtgagaggaaaatggcagctgataataaattattaggtcagtttagcttggaaggtataccttcagctcctcgtggtatgcctcaaattgaagttacctttgacatagatgctaatggtatagtacatgtttcagcaaaagataaagcttcaggtaaagagcaagctattaagattcagtcttctggaggattaagtgatgatgaaattcaacgaatgataaaagaagctgagcaaaaagctggagaggatgagaagcgtaagaaatttattgaactgaaaaataatggtgaaaatttagtgcactctacggaaaaatctttaaacgaatatggagataagattccaaattctgataggcttgaaattgagaatgctattagagatgtaaaagatggtctcagtagtagtgatatggaaagtgtagatgttttacagcaaaaagttgatcatttgatgaaagtatcaatgaagctaggtgaagctttatatggtaatgctgctaataatccttcatctgctgagaacagtacagcaagtaataacgaagaagaagattctaaagttgttgattctgattatcaagagattgataagaaggatagcaaatagtactactactcttattgagttatgtgacaatagagttgataggtccactatattgtgttaggattgcattgggagtttctgtattgtacgttgaagttaagttaattcctcgagctcgattgatttttttagggagctgtcactgttagttatggagactaataaatggtgcccaccttagcttaagtctcaggatattcagagcatagacggcaatggcggtttctccccatatggggtatagttttgtgtttcttacagaatcttgttatgtctaacaatgaatataacttaaatgatagtgaaattatcaatttttctgctattgatttattcaatatagtattagatgttgaaaagtatcctgattttcttccatggtgtaaagcagtttacgtaaaagagcgtagaggaaatgtaatagtagctgatttgttagctagttttaaaggattaagtggtcaatatacttcaaatgttatgtttaaagagcctactgtggatcaagaagggtggataaaggtagaagcagtagaaggattatttaagtttttacataatcagtggacttttattccaaaaggagaaagtcaaacgttagtacagttttacataagttgtgcttttaaaatacctatgttacagtccgcatttaatttggtttgcgatactgcatataagaggataatgtcttcttttaaaaatagagcaaatagcttattattaccaaaataatgtatctatttaatgttgatactatgttttacaagttacataggatagttaatatattcaacaaataaatggtgaatctgtaattttatttttacagattatatttaataatcctgtgtattagttgtgctgaaactgaaagataatttgttattattcaaaaagatataattgatcatgtatcagcaaaaaatagataagtagtggaaagtacatgttttataataacttaatactttattgaaaataaatcattacatgtagtagatttaatgactaaaatttcttcattggaagaaaagaatctttgatagttctaattaacataatgagcgtgtaatctttttatgtaatagtttttattgttgttgatatatatgttcagtatgaatatcaataattcaagaatacttgtctattttttctgatgttgtttcaattatttattaattgtagtatgatatcgtgcaatagtacttgttattatttttgtacagaagaataaattattttggtatgatgtacattttaatttctaatatttagtagctatttttaatgcgatttagtattagttatatatgcttgaaaaaataataatataacttgagttattatgactgagtatcttgctaaccgcttctctattatatcttttatacctaaattagcttttttagtatttgttgtattagagctcctgttatacgatacaaggactgaaacatataattatagtctaatattattttttgtattttcttttattattgttctaatttttttatatatttggaatataaagaagcatgagacgattttatatcttttatattatttaagtagtatagcagctatttcttcaggaaatttattgtctttagttatatcatttgaatttatggcattgagtgctctaatgatagttgctgtaaactcttttggagctaataaaaattcagtgatacattattcatgtattcattttttgtctggtgtactgttacttattggggcatctggtgggtttttagggataattaatggtgagtattattataaattattttttttaataggtttattgatcaattgtgcttgctttcctttatcttcttgggtgacagatgcttattctgcagcattgaataatggtattttgatcttatctgtgtttactactaaagtttcagcatatgtattattgttcttttttcaaggagaaaaaatattactgtttttaggtatagcgacgtctgtttatggcataattttttcaatgttggaaaataatattaaacgtttactttgctataatttagttggacaaatggggttggttatcactgcgatagggttttcttataatgatggtgttgatatttatggtataatcgttttacagatagtcctgtctataatttatcaaactttattatttatggttgctatttctgtgataaatagtactcaaaaatttaatcttagtgaaattggtgggttattcaataaaatgccagtagaggcagtatgttctgcaattgctatatttactatgggagctttacctggtactggtggttttgtttctaagtttctaattacacataatataaacaatgtagatcttgcaagtgtgttgatgggtaaattgttcttgatatgtagtatattgttatttgtgagtgttggaataaaatttttttggtatgcatttatatctaaagctatagaaagtcctattgttagaaaggtttgtgcagcatctaagttatcgatgttgatattaacattagtttgtacgttttttggagtatttggaagttactatttgtttcatgatctagatagtgaaaagctaagtagtattgtgttgcagtgtggattaatatttggaagtatattattctttatctgttttcatccagtttttaaagggagagttaattttactatggacattgattgggtctatagggtattgtttatgagtgtaatactgtttatcaataattttttgttatgcatttataatattcttattacaatgttaaacaatgtattaagtacaagaatattattgtattttaaagatggtaggaaaattttaggtatatcaagtattgatcctttaggatttactataatatttggtatgttatttattattattatggtcgttgtatatttatgtttgagtctttaactagtagtttaactaatgtaatccaaaagatgcagagtaagcatgttatttcttctgaggattttgatgctgcgatggaagaagtaaaagttgctttgcttgaagcagatgtttctttagctgtagttaaggattttattagtaatgtaaaagagaaaatagttggtggcactactgtaaaaggtgtattgccaacgcagatgataataaaaaagatccaggattgtttaattgaagtattaggatctgaaaagtgtgaattagatatttctaagcctttgtctgtgattatgatggtagggcttcaaggtgttggtaaaactacaactacagctaagttagcgttaaaacttaaaaataaaaaaaaggaagtagtaatggcatcgttggatgtgtatcgtcctgcagctcaaaagcaattggaaatattaggcaaacaaatagatgttcaaactttaccaattattgaaaatcaggctcctattgatatagtaaagagagcaatggataatgctcagcaggctaattgtgatgttttaattttagatacagcaggaaggttgcatgttgatcaagtgatgatggaagagttaagggctataaaagatcttacttctcctagtgaggtaattttagttgttgattctatgataggtcaagatgctataaatgtagctaagtcatttaatgataatatagggattacaggtattattttaacccgtattgatggtgattctagaggtggtgctgcactttctatgaaaatgtcagttggtagtcctattaaattcattgctaatggagaaaaattaagtgatctagatgatttttatccagaaagaattgccaaaagaatattaaatatgggtgatgttgtatctctagtagaaaaagctacagaagctgtaggcaagcatgctatagatgagatgcaaaaaaaagctcagaaaggtaaatttgatttaaatgatttagtacaacaactgaaggcgttaaataagctgggtggtattgccaatattttaaaatttatgcctaattttggtgctgatgttaaacgtcaagtttctggaattgcaaatgatagtagagtgaaacagtatattgcaattgttaattctatgacaaaaaaagaaagagaaaatcctaaaatattgaatggtgcacgtaaggctagaattgctaaaggttctggagtacatgttaatgttattaatatgcttataaaacaatttaatcaaatgagtagcttgatgaataaatttagtaaagttgactatagtaagattaaaaatacagacttcatgaatatgtttaacaaagaatagtttttatcaggtggtatatatttatagagaagtattatcgatatgtgtttgtaaattctaagtttttatatgaaagctaaagtgcaataaagttctgtagaatagggaatttatagcatattacttttattaatgatttagagtatccttagtaaaatagttatatattgtatataataatatgagttgtatagtttgtgaattttttatatcagggatctatgtgataaagagtctgttgtaagattgtataatggattttagcgaaaattactttctttagtagtctataaatatttatataattttattgtaatgattgaagttagccttttaaattgttaaaaaattttattgcatactatatgtttttggtgtgtaatgtaaaagttggttttataatgttcacttacggaattggtgttgtattagccaaagttttacacagtagcattaagagtttcaagtatatactgtataatttttatgttttttgtaaatgtaggaatgtactgtatatttaattacttagtattagcaagggaatatggatcatataagtaaaaaatgttctatgaatgctatagttggtacaactaatgcaggaaagtcaacattaattaatatgctagtaggacaaaaggttgcagcagtgacgccaaaggtgcaaactactagagttaggatgcatgctgtattgaataatgagaatgttcaattgatatttatagatacaccaggtatcttttctccgaagacaaaattagaaaagtttattgtaaagcatgcttggatgtctcttaaaggtattgaaaatgtaatactgttgcttgatgtaaaaaattatttgaataagcatattgagaagattattagtagaatcaagcaatctaatatcaatgctatcttagtagtgaataagattgatacagttcctacatcttcagttgataaagcaatagaacatatgtattcactacatagttttagtaaaacttttactatatcagcattgcatgatattgggttaagtcgtttagttgattatctatgtgaaatttcacctaatggtccttggttatatcctgaagatcagattagtgatgcaccattaaaattttttatggctgaaattacacgggaaaagttatttttgtctttacaccatgaattaccttattctttatctgtagtgactgaagcattagaagaaaaagaagatggaagtttagttgttaagcaggtaatatatgtaactaaagatagtcataggactatcattttaggcaaaaaaggagagatgataaagaaaattagcatggaatctagatctgatcttgcaaagatccttgatttaaagatacatcttttcttatttgtaaaagttagagaattttggcaaaaccatttagatgaatgtgtagggtatgttgaatagtttattggtttttgatatagaaacaattccagatgtggatgtttgccgtaatctcctcagtgattttgatgagacagttgagttgagtgagaaaagggaagcattaataaattaccatttagatattactgatggtaaaaatccatttttaaggcaaccttttcataaggtggttgcaattagttttcttaaagcagatattaaaaagatgggagaatatgaatctttccatttgcaagaaatacgttctggtggaaaaatagattctgtcgaaaaagatttgcttaagggattttttcaatatgtttcatctttgaggccaagatttgtgtcttttaatggacgtacttttgattttccagtgttaaaatatagagctatggtacatggtatacaagcagggtgtttgtataaaattggggataagtggaataattattttcaacgctatagcatcgactggcattgtgacttattagattatctttctgattttggtacttctgctagaataaagatgaatgaagtgtgttcagtgttaaattttcctggtaaatttggtcttgatgggtcaaaggttactgcactatatgatagtggtaaaatatctgaaattcgagattactgtgagacagatgtaataaatacctatttggtgtatttgagaatgatgcattatcaggataggattacaacactaagctataatgatagtataaatgacttattgtcgtatttagattccagtggaagagaacatttcaaacaatttagaattgagtgggataaatcttgtggtggaaatttttatctttaatcatatataatatattcaattaattaatttatatatttgctagtatatcattattgtattagtaagttttttggaatccattatgcggaatgtaaaatatgtattattttggttaggttttatagtattagtcatgctatttagtggtacaaaggatgatattggtggcaataaatactttaataaattttttcctaatgctgcaactcaaaataacaaagttaattatgttgaaggaggagttgaattttatagagccaaggatggccatttttatatagaagctatgatacatgggattccagttaattttttagttgatactggagctactgatgtagtcttatcagtggaagatgcaaagagattaaaacatcatctgaaatatctaaataagaagaaaacttatcatactgctaatggtacagtaaaggctttgtatgtggaaatatctgagatgcaggttggaaaatttgttgttaataatgtaaaggctagtgtaaatgtttctccgatgcgtacatctcttttaggaatgagctttttgcaatattttcattttaatatgagtggagataagttaacattacattcttattaatctgtagtacttatataatcgaatgataaatttttacgaaaatacttattataagtattaagcaactgattgcttatggcatgtgatttttaggttaagctgtactttatttacagatttaaataaatgtttctagtagtgaattttgtaaggaatgatacaacaagtaatttgtcagtgtctaacttggattggtgactatcttgagtttatcttaatatttttctaataggtaagttttgtgtatagaagattctcgaatgttagcaaatatttacatggttatgatacatgatgtttagttgattattaatgtgttttattttttcagatagggggaaattattgatcataatactacatgagtattgattctaaatgtatctgttcagtatgtggaattagataaaagaatagctaacatgtgtaactgtatctattgtgttgttgatttttggataatgtttaaaaatataagattgttagtagtaagtttgtagttgataaaaaaggctgctgtgccttgtattatgtagtaatatgtatctttattatttatcaagtgtgaaatttatgaaaaataggttaaatcaattaattggtttaatggaagagtatgaaattgatgtattgttattgcagaatacggatgaatatcagtgtgagtatgtgcatattaacaagcaaagaataagatggttgtgtggtttttctggctcaaatgctactttgataatatcaagggaaggtaaacagaatttttttactgatggtagatatacattacaagcaacaagggagttggactgtagttattatcaaatacataatgtgtgtgagttaactccttggcaatggtgtgtagaaaattgtctatctcatactgttgtagcttatgaatctgcattgtttactttgagtcaaataagaaagtatgaagattgtggtatttttttaaaaccaatagatcaaattttgattgataagttgtggattcgtgattttgctatagaacatgatatagtacagcattctttagaatattctggtgttgagagttatacaaagtcttgtgaagttgcaaaatatttgtctgacaaagatgctgcattaatcacaaatactgatgttatttcatggatgttaaatatacgtaataaaaagtttctttataatccttcagtgttgtctagagcgattttatataaggatggaagagttgatttatttattgatgatgtttactcagtaaatgttaaatatgagcatcttaatatatgttctttgaataatctatttaatgttttgaaatctgtaaaatcagtagttgtagatgcatctactataccaatgagtatttttctatctttacaacaacaggatgtattagttaatgatgcagatttttgtcttttaatgaaagccagaaagaatgatgttgaaatacaaggtgcaattaatgctcatgttagagatggaatttctatagttaatttattatactggttaaatatgcaattggataataatcagaaaattacagagctggatgttgagtcaaaattattagatttcagaaaacagcaaagtttgtttcaaggtgaaagtttttctacaatttctggttttcaagaaaacggagctgtaatacattacagagcgaataatgatacaaataagttaatatgtaagaatggattatatttattagattctggtggtcaatatcttgatggtacaacagatgttacgcgtactgttgctataggtgaacctacatctgagcaaattactaattttacgttagttttaaaaggtcatattgctttagcgatggcagtctttcctttaggtactactggtggaatgttagatatattagctagacagtatttgtggaaatcaggacttgattatcaacatggtacgggtcatggggtgggaagttttttatcagttcatgaaggtccttgtgctatttcgtacaagaatgatgttgtattgcagccaaatatggtgctatcaaatgagccaggatattataaaaatggtgaatatggaataaggattgaaaatctgatgtacgttgaagaatatatgaatggctttttaagatttaaacagttaacatgtgtgcctatagatttaagattaatagatgtagatatgttaaatcatgaggaaatcaattacatagaccagtatcataattttgtatataacactattgctccacatgtaagtgaagaagtaaaacattggttatgtcatgcatgtcagagtttaaaaggtaagtagatttgttttataagcactttttgtatgtttgaatatttttgttttttaggtatatctaaatcataaccttatgtatgaaataatagctgtattctattgtaatatacatattttatgatttgctgaatatataaagatctgtctttttatatagagatgatggtgcttttagtaggtatgatgcacattgttgatatatataataatattttaatttaattatattgtataatcatatgataatatagctttttgttctaatttatattctaaagtaatgtaccagagacattgttttataactttctataaaaaatatttccagaaaataaaaaatgctttttatagcgtggtgatttttttaaatgtactatggtattaatgaaagcaatgatttgttagtaggttggtcagatgtttttatggctttccaacaagcttgttttgcagtacttgcgattttatcactcatagcgtatattgtaatgtctcttgttttgtcttgaatattgtgttttgctattaattctataagtattttagcagttcttgatgaataaagtagtatacctgatattttgttttgtaataaggcattataacaacatttactcaagtattttctgtctattgtattatatagtataatctcttgaaagttatggtaatggttaaaacttttttttaagttatatgtaacttctttgcctcttatgtataatatattagctctgttgtggttttttatataagatataacgttatcaatatttccattgagtgattttacagatgtaaatcctaattcttgtgcagtattcatggtattattaccgacagtaacaatgggtatattccaatttttagtgatcttgctcaaagcgattatgctatgctggcttgtagatatgattaaatcgaaatcgtttatattgattttagttatcaggtattttattgaaaacagtggttctatgtagacattaaaaccttgcttattaagatattccttaattttgatagaatctttttttggtcgagtcactaataaagatttcatagaatagattatgtacttaattaaaaaaaatatctcagtatgtgtagacaatcaacttaatatttagtttaagaaatctatttagaaatttattgagtgtaagttaatgtataaattacaaatattatgattaataatgtgaaaatttggctaattgtggtagtaaggtgatttgttctatagatctagttttcattttacattatattaatttagtagtagctttaacacttatattaagtatatcattaatttattaataattatttgtcaataatttatactatgttataaaaagattattgtatgaaatttatatgtagaatgaagtatgctataattatagttttattttttattatcttatttattccgtgtacatcagtatcagtgggatgtgtaagatatgatcagaaggatattgtagttggattgatatctactgagtttattagttaccctaatgagtataaaacggctttgggaattacacaattacttcagagttatggtgttcgtgtagttcttatggattataatgtaattatgcagttagtgaaagatgaaatagtaaagattaataaaacctataaagcaaattgtaagatatcaagatacgatattatagaaagtgtggttctaaagtttatagaagagcataatatcaatagaatatttataccaggaaaccactataatattagttctttaccaattgctccgtctttagatagacaattggttactaatgctgtcgttaaaataattcataatcaaaatcattgtatacatcttcttggtgtttgtggtggtttacaaggtataatgtatgcaaatggaattaaaatcacaagggtgaaggatatagttaattctgatatttctgtgaaatcacatactgtgtcaatgcctgatcctagaagtgtgtatgctaatttacataaaatcaaaatttttcctaacactaggttatcaaatattgcagttgatttgaaattggctaaagatcaaattatatattttccagatgcacattcagaagcaattgatagcaatgtagagaatgtgatgaaaatgtataatttgggatataaaattgctgctatgtcggaggatggtgttatagaggcgatagaggataaatatggtaatatatattttcaatttcatccagagtacttaatgattaatgccgaaagaaaatttggggacaatacaagtagagatacatcaattatgcttgcggatgcaataattaaagattttctttttcgtgattgaagagatttagagataaacaaatttatattaacgagtgcgtattttgagtaaatatgtttacttatctagtatgatgtgatttttgactttggtataagtagtgaaggagctacttgtttaattatatttatgttttctgtatgtattgatagtatagtggtttttataatgttattagttttgtattcaacagtttagtatttaaaaaaatgtgtagttgaaagatagctttacaagtaaaggtgtaaattttgattcttttgttataataaaacagctctgttatttaaatgtttagatgatagctgaaattttacttccggtaccgattaataagacattttattacactattccagagaatgatatgttctgtgttggtgaatatgttcttgtaccttttggagctagaaccttggtaggtgttatattgaaattgaatgatatgataccttcagattgtaatgtagaaaagttacaattaaaagttgtaatttctaaaaattctttgccaagagttaatgttgcgttacttaattttattaaatgggtgagcgactataatattgttccagcaggtttagtattaaagatggtgttcagtaatgtagtaaatgctaaatcttttagtaagctaaaattttatgcaaaacaaaatgacagatgtaatagtgtagaaattaatttatctaatgaacaaaggattgcatataatagtattgttaataagatttcaggttattcagttatagtattagatggggaaactggctctggaaaaactgaagtttattgtgaagttatacgtgaattaataaaaagggatagtacagcacaagcattaattttacttccagagatagtgttaacattgcagttaataaagcgtataaagcattattttgatagttattatccagtagaatggcattcaaatttaacattaaagaatcgtaaggaatattggttatccatagcatatgggcagtctttgattgttataggtgcaagatctgctttatttctaccatataaaaaccttaagatgattattgtagatgaagaacatgattcatcgtttaagcaggaatgtggagtgctatataatgcacgtgatatgtctattgtgttggcaaaaaatttggatataccaataattttgtcttcggctactccatctctagaggcgatcaacaatgtattaaagtctcagtattatcatgtgaaattaacgcaaaggtttggaaatgctaaattgccatcagtgaggattgttgatttatgtaagagcaagatggtcaatgtgtggttatcaaataaactttataatagtatattggaaactttgcaaaggcaagatcaagttatgcttttcttgaatcgtcgtggatatgcaaaattgagattatgcaaagcttgcggttttaaaataaactgtaaaaactgtgctacttggcttgtagaacataaaaagaaaaacatattattatgtcattattgtgggtattcttgtcccatgcaagatgagtgtactaactgttcagataaatcttctcttatatcatatggggtaggtgtagaaaaaatagcagaggacattgttgcactaataccaaatgctaaagttgcgataattagcagtgatattagtagtaaggatgtaagtgttatgattgatatgattatgcgtaatgaggtaaatgttattattggtactcaagtgatagcaaaaggtcataattttcccagattaacgttagttggtataatagatgctgatttaagtttgaataatagtgatttgcgtgctacagagagaacttatcagctgttgcatcaggtatcagggcgttctggtagatttgcagataacggtgaagtaattttacaaacttatgataccaatagcccattgattaaatcattgtcatcttataatcgtgaattgttttatagtttagagctagaatctaggttattaactaaaatgccaccatatacaagattaataggtataataattagtggtaaggatgaaactcatgtcataaatgtgtcgaagcaaatagtaaagagtcttccccatactttgactgttttgggtccagctcctgctcctataagttttttaaataggaaatatagatatagaattttgattaaggtacagcataacgttattatacaaaaactacttgctaagtataaggagtattatgcaaaagcaaataaaattaggattactatagatgttgatccagtaaattttatgtaaattgttattgggtatagataagacaataagttattgttaatgaatattaagagatattgcttgtagcatgtaactaacgtgtaattcagcaaggtacattatatttatagtaattagttattttgaatctcaataatctgaagaatttgtgtttgactaatgttgatgtattgttataatgaatgcctgttagttagtgttttaggtttgtaaaatgagtagggtttgtgatattacaggtcagggaaagtcttttgggaataaggtatcacactctaatcgtaaaactaaaagggcttatttggttaacttacataatgtaactttagtaagcgatattttgaataggaagtttaaatttaaagtatctagtcgtactttaaggacagtaaattataagggtggtttggatttatatttgcttaacacatcgtctagaaagttgactgataaagctcaaaaaataaaaaaactagttaaaaatgctgtggcaaaaggtgtgaaagtttctttataatttgaaactcaatttgatgcactcatttctataattccttacttttatttctaagctaagtcctctatttaatataaagtatcaagtgtaagtgtaataaaaagaggaggagtgtatagggtgttgtttgttcaatatgattgtgagtaatatggcagatatgagtgggtaaaatattgtatatcataaactgtaggtttgtaagtacgttttttaaatctgaacttagtgttatttgtgttgaatggtaaagttgttagatgtttgctttttcctaagtaatagttattagagcaggtatttctatataagtgtgcaagatttttttatatctggtttatatttcttgagcaggtatacttgttaaatataaggttataaatcttgcttatttaaaaataaagttgttagatgacagctcttgtttgagtaatagttattagagcagggtattctatataagtgtgcaagatttttttatatctggtttatatttcttgagcaggtatacttattaaatataaggttataaatcttacttatttaaaaatagtattagtttgttttctggaatgttgatgtaaagttttttacctgatgcataattgtattgtatcaaaaaatatatctactaatgtgaccatagaagtaatgtaatacttagttgtatctgaatattagtgagattttttctgttttaattcatacttgttgtgttatgtaagtatatgaataaggttatcagtaaatgttctttcctaagtagcaataccgattaaaattttataagttttaatatctgtttcgtgttatgcaatagtgctaatagtgaaaaatatacttattggaaggatatttaatcacatatttaaaattctaatatgatctcatcttttaacatgtcttcataagtttgcctagaacgaataatgtcataactactgttgttaaccattacttcaggtattaataatctggagttatagttacttgacattgaagatccataagctccagctgtgcatattgctactatttctccgttttgtaaattatgtatatgataattatgtgcaaaagtatcatcagattcacatatagggccgactatatcgcatggttgtagttgtgttgatgttgaagaaattgctggtattattgtgtgttcagcgttgtataatgctggacgtattaggtcattcattcctgcatctaatataatgtgacttttttcttgattatatttacggtatagtacttttgttaatagtataccagtatttcctactaatgctctaccaggttcacatatgatttgataattttcattttcaaaattcttttttagtaagtttgcatattcttgaattgttgggaaggtatcagaacttttatatggtattccaagtcctccaccaaggtcaaccctgataatttgagtattatgttgcttaaaaatttttataattttttttattttgtcaattgtattttggaatatgtgtagattggaaatttgtgaacctatgtgtacggatattcctataattttaatccaagtaaagtctttattgaaaatttgatcaagtaattcttctggtataccaaatttattaactttcaatcctgttgtgattttatcatttgtatctgcattaatattcggattaatcctaatagatactggtgcaattatatttttttgacatgctattgtatttatgagagataactcttcaatagactctacattaaattgtagtattctattgtccaatgcgaaatttatttcttgctcagtttttcctacgccagagaaaactattttatttggtgaaattccagctgcaatagcacgtcgtatttctccttcagatacaacgtctgctcctgctccaagtgaatttaataaacttaaaatagataagttagaattcgacttaactgcataacatactatagaattattaggtagattttcttggaattgtctatagttattttttattgcatttaaagaatagcaatagacaggggttccgacattttttgcaatatccaatacatttacgttttctatactgagtatgttgtttttataatgaaaaaatggattagcaagaaagatcatacaacgctccaagttttagcgatttaaatttatataatattcctaatatataacataaatttataatcatttataatattctattacaaattaaaagttatagtttgtcagaataatatttaaacttgtatatggagaataatgtcatagtaagctaataggatgttgataaatataagaatttatactttatatagtgtaaagacctataaaaatgtggaaagatttggctactatagagctatttaagacagtatatttgatcagtaaacattgtttattggcttaattgttctaattcgtcaattagcatttgtatatcattaggaatgtaagaatgaaattctatgtatgtgttgctcgtaggatgagtaaaccctaatttataggcatgaagggcttgtcgttttaatgtattgataatggtactttgtttagcatattttacacttttactgttgttttttccgtatttttgatctcctattatagagtttcctatgtaactcatatgtacacgtatttgatgtgttctacctgtatgtattctacattttattaaacttgctatgttactgaagcttttttgggtttgatattcagttattgctaatttacccttatgtggtaaatgcgtcacagtcatcatttgtttattattgggttttacacagatatagtttttgatagtattacttttagggttaggtaacccccatactactgctaagtattctttttttatttgttttttgagtagtagatcagataaaaaataatatgatttttcattttttgcaatgaccattagtccgctagtatccttatctaatctgtgaattattcctggtcttgttgcttttcctacatgacttaaactgttgccgtaatgtgcaactagtgcatttactagtgtattattatttgttcctgctcctggatgtacagttattccaggggctttgtttattattattatatcatgatcttcatatactactgaaattggtatgtagtgattaggggtaattgtgtcactgattgtttttataggtatgcttatattataaatgtcatttacttttgttatgtgattgttgtcccttattatggtatcaaaaagtagaattttactgtcttttattagttgttgtacttgattacgagatatgtttaatttacttgctataaatttatctaatctgttattttcatctccacttttaataaaaatttttttctctagcatttttatattataatttatgtcgaagtaatatactgtaatcactagttatagtcaaaatagtgaaatattacttgtggtatggttgtatataagtaaaattttagactatctttatatataaatgaaggaattaccttttaattaagagtatttaagataatgataaaaaaaatattaatagcaaatagaggtgaaattgcatgtagagtaatgagaactgctcgtaaaatgggaatatcttgtgtagcagtatattcaaatgcagatgtgtactcattacatgttttatctgctgaagaagcagtaaatattggtcctgctccagtaaatcagagttatttgaatatggagaaaatttgtgaggtagcttgtaatacaggtgtagacgctgtgcatcctggatatggttttttatcagaaaatgctgattttcctgaaaaacttgagcagtataatattaagtttattggtccaagttctacctcaatcagaatgatggctgataaaattacttctaaaaaaatagccgagtctgcaaaggtgaatattattcctggatatatgggaattgttgattctgttcatgaagcaaaagaaatagctaaatctatagggtttccagtaatgataaaagctactgctggtggtggtggtaaaggtatgagaattgtgaagtcaagtgaagaaatagagcaagcttttacttctgcaacaaatgaagcagcaaaaaattttagggacggtagaatttttatagaaaaatacgttgagttaccaagacatattgaaatacaaattatagctgataagcatggcaatattgtgtgtttgggtgaaagagaatgttctatacaacgacataatcaaaaagttattgaggaaactcctagtccgtttcttgacgaagaaacgaggcaaaaaatgtatcagcaatgtgtgaatcttgcgaaaaaagtagggtattattctgctggtactattgaatttatagttgatcaagataagcaattttatttcttagaaatgaatactagattacaagttgaacaccctgttacagagcttgtgactggaattgatattgtcgaagaaatgattcgaattgctgatggtgaagaattgagatttactcaacaagatgtgaaatttactggttcggcaatagaagcaagagtttatgcagaaaatcctacaaagaattttttaccttctagtggaagaattgcttattattctgctcctatgcctaatgataatttacggattgatagtggggtatttgagggagcagaagtcagcatgttttatgatcctatgattgctaaagtttgtacttatggtaaaaatagagatgaagcagtgagttttatgcaaagatatttaaatgagttttatattggtggcattgctaataatatagactttttgttatctgtatttcatcatcctgtatttatatctggaaatattaatacgaagtttattgagcaattttattttgatgggtttcaaggaaatcctctaaccaaagcttgtattaaactttttattttgacctcactatgtatattctttcaagatgaatatggtattcatggggttgaattatgtgaaaatagagaattagctgtttatgttgatggtcaaaaatatttgattagtgctaaatatgaaaatggtagagttttggcaatttatgaccagtgtgagtatttagttgtaagtacatggaatgtgaattttaaaatattacagatccaagtaaataatgatgaggtatttcatgtaaaggttgatagtagattaaataaatatcaacttaaatattctgctatgagtgcattgtgtgcagtatataaaccttgtgtatctgatctactacctataatgcctcagattagtggggaagagttatattctagtaatgtatgttctcctatttctggtatgatagttaaaatttatgttaaacaaggagaagaagttcaaccaggtcaacctttgttagtaattgaagctatgaagatggaaaatgtgatatattcagatgtaaagtcaattgtgaaatctgtattattttcagaaggaaacagtgtagctactggtgatgttattatagagttttagttggttatatttattttttattgtataaagactgcttacaccttaatagtatagattttaataaattaatagatataaattgtgattgtgctaaaatacgattacaagtttttgtaaaagtaagtcgttatagtcttataaaagtttaagtatatttagacggggggcgtatatttttagataattcatataaagtaaaattgtgattatctaagtattgaggtaatgtatgttattaagtagtacatataaaagtcaatcgctagttgatttcctcagttccatgattcaaatagataatgtgagattggagaaccactttttatacattgatataatatataacagtgatgatgacagaaaaaaaattttaaatgttttacctcgtggtgttattcaggaagatctagtagattgtagattaacggtaaaaaaatcagatttaattttttttaaaacgcaacttcataatccttttcgtgcgacagctggtaataatgaatataacatcagattaatgatgtatttgatatttgaagcaacagatctttgggaattacactgttgtgatatttatagttctataaaaggtcattatcagcatgatcagcgtgaatgtaaaggaatattccagcaattgatgagttatttctttaaaagtaaagaatgtgttggaagaatgggtgaagattgtgtaagggatttgaatcctttatgttttccaaacccggagttgttaaggagtaagttatgtatacattctgatggtaaatattatgtttttttatctactataaaagaatatgaagatagtgttttatttaaagtaattacaaaaaaattgcaaatgctggaattagaaagcgctaaatcatctgatgatagtgtattattaaaaatattggatcagaaaaaatgtttgcagtattttattgcttgtctgtcagacgtaaattgctttaattcattagcggtaccatttcatgtatttctagaggcgttaaatattttaataagtgatcaggtaatagtaaaagaaattgaaggtttattaagagaacgtcagctacatgatatgataaatcatgttgcttataagttttttcaagataaaaaacaatatggtattgatgtatatggacaagggttagagaaagcacatgatatatattatgaattatatggaaataatttaccggaagataatttagcagtgaaaaaagctatattgagtttacaaaatgtgaagttcaatattacagcaaatcttgatttttttattaaaatgaatagtgataaagggattttacgtgctcaacagtattttaggggattgactgcacttgtagaagcagagattaattttttgcagaagttccaagatgttttagtaataaaagatttagatttgtttttaaaggttacttgtaaaaatgttcatgatgatattaatcgattgcttgctgcatatgatttctttatgcagaaaaagattgttgacaggaatgcaatattaaaatttacgaaaaaagaactcttggaattgacacaatataccaatagtagggtacttttgttgaaagaaattgtcaggtatatgaacgatagtataagggcaaagaatataaacaagagttttcttagcgaaagagttattggttttatagtagataatcatccaatattaagtacacagttgttaaaagataatcgattaatatcatctatagattttcctggattaattgattcaatagtgtgtgttaatggaaagtggataataagaaacaaagagaaaaataagtggcttttacgtcaattaaaattgcattctttgatagattacttagatataaacatagactgtttggatattcttgatgaattatgggataagaaaataagtgatagcaaatttctcggtatcttacgagttattataaacaatagtcatacagataaaaaatttatttatgatgttaaagttagtaaatctttgagagtgttacaagttttatatagaatttcacattttataccattttcttctatatggcgttattatattaatcctagtcgttatcgtactacgccaggttatgtaggtgataatgttaaggaaaaattatatacacaaaataaaaaaattcctgttacatcattttcaagtaaaattatagaaaatatcaaattatgcaattctgaagaaagatatgttcaaagttattatgaagctaagtttttaaagaaaagaattcgtaaggacaataatatagcaggaagatttgaaaagctgaaaataagactattatctaataggtttgtagcttatgtactttttggtcttatgtttgttatcatactgataagtgcaattgttggtaggatacttatgcattttaatattataccaggtgtttttattggtaagtttatttatggaatgcaggggatatttgattcgttgtgtgtagtagtagggttggatactatagtagataaagggttaagtttgattttagatactgcaggtattattgttagggtacttgattttattttgttatgtggtttgctctcagagtgtataaggttttttataaagttggtatatttaatatgtaagcatgtttataaggtatgtgaaaacatttatgaatttttgaaaatttatgggtttaagtattcatgtattattttattgagtaagatttggtttattaagcatagggagtttgagacctgtcagcaacaaagagaatctagtgaacaggggtatgatattaatggtggtttgatagaagcattggaacagatttatggtaaggtgaaggtcagtgatggtctatcatcacgcattattagtatgacacgagagctatcttcgcagattgatcagattctatgttgtaataagcccaaacctgagtttttgttaaaagagtttgaaagtcatacctctaaattgcctcaggatgtggtaggtaatgtaaattatattaaattaaaatatgagttttcttatttattaaataattatacagaaaagattaactattgtagtgatacagacaggttgaatattctaaatagttttcaaaagagatcagcactttatgacaagattactgctgttaatttacagaccagatattttcataaggattcatgcgttaaaatatgcaatacacgagatgtagagcgtatatttgctgaagcaaatactatgggtgatattgtaacagtagaattattagatgcaaaaattgcatcattaaaatgggcaatacatatgttagatgttcatgatgtttataatatcaaaaatagatcagagccggtattcttaaatactaaagtggaccatagtatgactgtagtgctttatgattgtatattaagattacagaattaccgcaaacaactgcaatttggtaaattaatttctaaaaagtttatagatactgatattgatagtaatttttctccatatataagggatgtatatcatgttttacagtcactggatgataatagtatgcttaacagccagacatcaagtataagaatatttgttgagaacttttttgattctaatagtttattattaaaaaaaccttcagataaagctaaagatttagctaattatattaaaattgataaaggaacagtatcttgtatgtcccgtattaaaaagtctatttatgaatttatagaatattttcaagatccaaagagcatttctatatcttttatattgtattatttactccgtttaacaaattcaataactttacttagtattgctgattatgttacacaaataacggatcatgcgttagatatagtaatgttagatgggttatatgaatattttacttgtactgattttggtaaattattgttagttgaattttatcaaaaaggtattttgtttaaagatataatgtttatgtgttctgaatttgatttaggattgctgtataataatatacaaacagttcaaggtagtttgcattgtcaagatattaattactctatatattcatcttcttttcataggggaaatcctgcacaggagaagatatcacaaatgattaatggatttatagaagttttatgtgaagggttgtttataaagggagtacaacaacttgttaattattttaaaaagaaggtagtatataatattcaatactttatgttacatgagaatatggcgtcaaattcagtattgtttaatactaaatgtgtgtctgattgttattattctgctgatgtaaaagtagtgcaggaagtaggttgtcgtaggcaaagaggagagttatttcttagtgatgttgatcataccttggagttaagtattgatcgttagtgttatatttcaagagtccgtttttaaagtgtggatggtatgtttttatggtagatgataaaagttacaaaacaaagtcaagtagcttaaatgggctcagtgaagatgctaatgagaaagttagtgatgttctacatgatgtaaaaacattagcatttagtaatattaatgaggacgatgattttaggtttcttggtaaagttaagttagaagatttagaagtccaagaatctattttggagcttgatggagcatttaataaatttcttatagagcatagtggagaatatagcggtgttatacaaagtcatgaatatgattatgatgcatctgcaggtgaagttcaaaatcttgatcttgacaattttgagatagaagaatctttcttacaaaagatattagatttttttagtgaactatgcgagcaaaatgaagattatatagattttgactatgaacttgatcctttgaagcgtaaaaggaaaaagaaaaaattcatattagaatccattatagagtttttaaaaaggtttttacgtagtggtcgttctcttaacctcaaggagttattagatgagcagatttcagagttgcaagaggaattagttaatgagctggatcctgaacgaaggaaattattacaagaaagattaatgcttcttacagagttaagagctcaaatgattcaatatggaattggttctaacttactctttcgcttttttttatttgcaagttttgtaagttctcttattgggttacaacaggatacttcgtctgctaagcagtatgttaaattagcagaagtacttggattatctttacacaaaggtaatgagaaggttttggatgcaaacagcaatagtattgttgcttctcaaactcttgttgtgactcctccgttaagtttttttgtatatggttatacgttagatgtttttcgtggtaagataaatgatgtatcttacaagttacaagatcagtatttttttgtaagagatgcatcacttcagctgggtcctcaatatggtgtgcaggggattttttttgctgtagctaccataatgaatgcaatagatcaggctttacgaaaagtggcgaatgctgttaaaaaagctgtagataaattagatatttttgagcattctaacaaatcttcaggacttcatgattttgatcgtgttggtcagcaatctcatagtactatagattatgcttgtacagcacgtatgaattttgttcaaagtactgctactgactttcagtgtacgactggtcttttatcatctttaaattaccaccgagagttaaaattttcgtgttctggggtttataataatagttacctagacaatataagtgtagtgcaatgcagtatacaaagtaatacaatgatatatcgtggtcattaatacatataatataacaatacatttatttcatggttgctaaagttttttttacttactaggaatgtgctttaaagattatttaagtgttattatgagttaaatttgtatagcgtttatattaaaaagaataaagtggtaatacagttaaaagtttaaatgtatataataatctttacaacatttgcgattagttacaaagtagtatgttttgatgtatatattagtttttattgtttaagttaagggatacttgtctataattttgagtaatttttttattatgtaatatttatagcagtatgcaaagtagtacaatgatatatcgtggttattaatacatatatataacaacacatttatttcatggttgctaaagtttttttttacttactaggaatatgctttaaagattatttaagtgttaattagttaaatttgtatagcgtttatattaaaagaataaagtggtaatacagttaaaagtttaaatgtatataataatctttacaacatttgcgattagttacaaagtagtatgttttgatgtatatactagtttttattgtttgaattaagggatacttatctgtaattttgagtaatttttttattatgtaaatttatatattataacatgcagtagtgtaaaatatacacttaataaactgtaagtggtatcaaatgttatcctttcttgacattaataccactgttatttatactcaactaataagaatttctaaattttactgtatgagaagtaaacctgattggttaaaagttaagatgcctacaggggatactttttatcaagttcgcaatttaatgaaattgtataaattaaatactgtgtgtgaagaagcagcttgtcccaacattggtgagtgttggaataaaagacatgcaacagtaatgattttaggttctacatgtactagagcatgtgcattttgtaatgttgtttctggaattccagataaactggatcctcatgagcctcaaaacttagctaaggctgttggtttacttaaacttgagcacgttgttattacatctgtagacagggatgacttggaagatggtggatctggacattttgtagagtgtatagaagaaatacgaaaaaacgatcagaatgttactattgaagtattaactccagattttttgaataaacatggtgcaattgaaaaggttgctgatgctgctcctgatgtttacaatcataatatagaaactgttccaaggttgtatgcaaaaattagaccaaaagcacgttactttcattctctttatttgttaaaaacagttaaatataaaaatcctaaagtatttactaaatctggaattatggtaggattgggtgaaacaaaagaagaaatatatcaagtaatgaatgatttaagatctgcggatgttgattttataacgattggtcaatatttgcagcctactcctaagcatgctgcagttgataggtatgtaactcctgaagaatttgatcattacaagtatgttgcatactctaaagggtttttaatggttgcgtcgggccctttagtaaggtcttcataccatgctggagaggattttcaaaggttaaagaaaaatcgtgctgctatgttcatgcatgctaaaagcaattagaattaacatggtagttaatattttttagaagtttgaatgtttataccagaagggtttttcattagttttatatgatatttaattttttagatagttaatcggtagtgtagttggttgtaatctgaggaaagtttttgtgattgagagaaagtaggctatacatattagaagtaaattttttgtatatttaatagaaaaatagaatctagatataaatctgattatatattatgtgaggttgaggtaaaaaggtaaacgttgagccatttttacaatggtatcgactaatatattattttattataaatgcttgtaagatttcttaatacgttttataagtttgatatcgcacttatagctcagtggatagagcgttaccctccggaggtaaaagtcgcaggttcaaatcctgctaagtgcacttattttttatgttattataaaatattaatgtggagcaacaatattgttgatgttatctcttttttcatagtttggtaatgatagtttagttaatgttgctttatgattattaatatatatggggaattattatttgtaatgtattaattgaagagtgaatcattgaatttaagtattttaaaaaataaaatgatcaaactttttccttataaaagttactataagatttagaattaataacattaaaagtagagctactatagcaattgcagctaattggataaattcaatatgtggattacttgcccacatatatatttgtacaggtaatacagttgttggatcgagaaaatcctttggaatatcaactatgaatgctaccatcccaatcattattaacggagaagattcacctaagattcttgcaatacttaaaatagcaccttgcatgatactaggtaatgctattggaaatgagtgatgtagaattacctgcatatttgatgctcctagtgagaaagctgcatcttttacggatggtggcactgctgcaaatgcttgttttgtagatgttaccaaatttggtaacatcattaatgatagagtcataccacctataagtgctgatgaacgtggtatatcaaaaatattgatgtatattgctaaccctaaaatgccaaatattattgacggtacagatgcaagatttgttatgctgatttcgataatagaagatattttattttttggtatgagctcacttaaacatatgccggatgtgatacctataggtaatgcgaatgttaaacatataattattgtaaacatggatcctattagtgagccaagaatcccagtattttcaggagatctagagttatattttgtaaacagtgcgtcattaaatgatacttttatcctgttttcattttgtaattttgcaataactttttgatatattgcatgatttatgtttttgtttttgatagctttattaaatgtagtggaagattgaaaccatatgttgaatttagtggattttggattcttaagtagaaaatctgctaaattatgatgagcagtatcatttattatattataaatgatttttctattgtcaggatttgaaagatctataacatttgaaaatagttcctctaaggattgatgaataaaatatattagattgtttctcaatgttagtttatcttgttgttctatagtatcattattgattgtaattgataataaaatttttgttgttgttagtgcattatatccattgttaacgatacttcctaaaattataaaaagtatacctaaggaactaacaagtgcagtcattgataggattgataagatacgatccttcctattttttaaggatatacgggaagcaatatgacgatactttagtaatttacctaatttttttcgtatgtgcatgttattataaatgttaacctttactgtatatagttttttaattctatctgtgattttttcttattaaaagtatttttatgtaaaatggaaatatattaatttggcatagagttgaattttagtgtactcgaataaatattatgtaataattcatgtacatcttaactttgcgtagattttatgtaaagttggactttttagttgtgtttatttaatagaggacatatgtttactttaccggaacttccatatcaacaagatgatttagtgccatatttaagtcttgaaatattagggtatcattataataagcatcatcagggttatgttaatactttgaatactcttgttacaggtacagattttagtaagtgtactaatgaggatttaccaaaagttattgaggttacatctggagatttaggatctagagctatatttaataatgctggtcaagtatggaatcataatttttactgggaatctatgaagaaaaatggtggaggatctcctacaggaaaattattagataaaataaatgaggattttgggagcatggatggttttaataatgcttttattaatgctggaaaaagtcattttggtagcggatgggtatggttggtttttgatgtaaatgagcagaaattgaagattgtatgtactagtaatggagatactcctattacacaatatccaaaaacacatcctttattaactatggatgtatgggagcatgcttattacttagattattttaatgtacgtcagaattacgtagaaacttttttacaacatttagtgaattgggattttgcagctcagaaatttttagcaatttaatttattttttattgttaaaggtaatcgatttgaagacacatatgaaattttaactatgttaagttattacttttctaaattttgagatattcttagtatttttattgattatttagtttatagatattaatttatttaatgttggttaatgataccttttagttttaagttaaaaggtatcatttttaattatatcataaggaaattctacttatgcttttatttcaattacaaataaatgttgagaattaatggtttattaaattgttattgttacttttaagattaatgcgtatctacctttaatggaaggggtttaatataaaataaaacattgccttatatgattgcaattggtgtttagattatgtaaatatatttaatttggtatttattatggcaggtactgttaaagcagatcagttatttaagggattaactagacctacgatgctttttggtgttagttatatatttgcaatgttgaattttatgatttgtatcatgatatttatgtatactaatgattttcgtgcattgtttattttaggtccaggaatacattcagtgggttttttagcttcatcaaaagaaccattattcttggagttatttatgctgaggatgaagaagtgtagtaaatgtttgaatagattttatcataatgctaattcttatgatgtaatgtgatgttaaaatttcaacaattgcaaacgaaaaaaagaaaagtaattaagagggaatatcatgaatctaattttattccctatagtgaacattggaattcttctacattgatgacaaaagatggatctatgcttaaggttattaagttgtctggttatgcttttgaaactgcagatgatgaggatttatctatacaaaactctatacgcaatcaaatgttaagaagtatatcttctgcatcttttggcttatattttcatgtaattagacgtagaagaaatgctttttcagaagggtttgcaagcgataaagtgtctagttcgtttgccaattatgtaaatgtaagatggcgggaaaaacatgcaacaaagcaatcttttactaatgatttatatattacaatagttagagaaggtggtaaaaaaggagtagaatttttatctagtatttttgataaatttggaaaagttgcatcacaggactcatggattaaagatttacaggctatttctgaagatttagatgaagtaactaatcgtgtttttacaagtttacgtaattatgcacccagaattttaggtattagagaaacaccaaagggggtgttttctgaaattatggaatttttgttacaggtagtaaattgtgggtcttttcaacgtgtattattccatgtggggaatgtatcaaagtacttacctatgcataggttatattttggacataaaacaatacaaatagttgcgcataatgaatgtaaatatgcagggttaattagtttaaaagaatacggtcaaacaacatctgctggtatgctagatgcatttttacaattgccatatgagtttattatcacacaatcttttaagtttactaacagacaaagtgctattaccaaaatgcagattcaacaaaaccgtatgatacaatctgcagataaagcagtatcacaggtagtagaaataagtcaagctttggatgatgcaatgagtggtagaattgcttttggacagcatcatcttactattttatgtacagaaagaagtctcaaaactcttgataatgcattgtctttaatagaatctgagttatctaactgtggtgtatatccggttagggagagagttaatttagaaccagctttttgggctcaattgccaggtaattttgaatatatagttcgtaaagctataatcagtacgttaaatatggctgggtttgcatctcagcataattatcctattggaaagaaatttaacaatcattggggagaagcagtaacagtatttgatactacttctggaactcctttcttttttaattttcatattcgtgatgttggtcacactgcaattataggacctactggtggtggtaagacagtattaatgaatttcttatgtgctcaggctatgaagttttcaccaaggattttcttttttgataaagattatggtgctgaaattttcattagagcattgagtggggtgtatatggttatagaaccaagacatcctacaggattcaatcctttgcatcttgatgatactccagataatcgtacattcttaatggagtggataaaatctttaatatcggtatttaatgataaatttacttctgaagatataactcgtattaatgatgcaatagaaggtaactttaagttaaaaaaagaacatagagtattgtgtaatttagtaccatttttagggttggatggtcctaatactttagctggagctatatctatgtggcatagtagtggatctcatgcagcaatttttgataatgcggaagatttattggattttaataaatcaagagtttttggttttgaaatgagccatttattaaaagatccagtatctcttgctcctgtattgttatatttatttcatagaattagtatttctttagatggtactccatctattattgttttagatgaagcatgggcactaatagataatccagtgtttgcaccaaaaataaaagattggttaaaagttttaagaaaattgaatacatttgtaatttttgctactcaaagtgttgaggatgctagtaagagtgcgattagtgacactttagtacaacaaactgctactcaaatatttttacctaatttaaaagctacgagtgcttataggaatgtatttatgttaactgaaagggaatatacattaataaagcatactgatccaagtacaaggttctttttagtgaaacagggagtaggtgcagtagttgcaagaattaatttgagtggacttgaagatataataagtgttttatctggtagggcagaaacagtattaatgttacatgatttaataaaagaagtaggagatgatccaaatgtttggttgcctatattttatgaaagagtaaagcatgtgtaaatttaataattaagaatattctttataaaagagttgattatgctaaaagttagtaagagtataatatatgtattaatgttatttttgattaatgttaattttatatgtgctaaatctacgttagcagcagaagttgaaagtgaaaaagtagctgtatatagaactacaattgctagtaatcctttatatgctaaagtaagtgaacatgctaagtatataggtattgctggatttactgctggatttgctcttattattggtagtatattctttctcaaccctgcaacttggtatgtagcattagggatgtttcttgcaggtatggcagctattgcttttgctgctgctaaagctgctccattttttgcttgtaattggtcttttgtgcgtcatccgattatgcgtttcgatactcatgatgcaaaaagaaatggtaatactgaaggtagttataaagaatgtgaagagcctactaagaattatccagattgtacgaatcgtgattttggttcagaggaggaatattttaggtgtcttgtaactggtgataaagatagtactaaacctgttagtataaacaatgctaaacaaaatgaacctgtatgtgcatctcaaaagtttaaaaaagtagataaatattattggcctaaaaatagaatatctagctctaattatatagaagtgtgttatcgtaatcccataggtagccttaatcctatcactatgattaaaagagcatcagaagcttcatcgggtaatgttactgaattattgaaaaaaggagaatatccaagggaaggtgattactctactcaggaaataaaagttgctaaatatgctatgcagggagaagtaaaatgtgaggttttacaagctggtcaagaaaaagtgatacatacgattacttttcaggctgtagaaaaagcagataagttatgtgtttatgctactaaatctataggaattcctttgtggcctcaagttgagattggttgtcatatgcgccccagtggacctccagttccaatgtgtgagaagtctacaccagttatgtcagatgataataagaggattgtaagttatgataattctaaatgttatagttgttatatagatcctgcatgtagaggtgaagttggacctcatataaaatctgtattcccaatgacttcaataatagtttcttgtataaaagggtccttgagcaatatattaactggtcaatgtggtcaaaatgctagcaaaaaagttggttttttgaaagttgctcaagataagttaaaaaaggcagtaatggcagttttagtattggccttaatattatttgcaataaaagcagcattgggtgggatacaaagtccagctgaattgtatatgttaataattaaatttgcattggtagtctactttactcagggatctgctatgtcacattattatgatcaaatagtaaagttatccataggattatcagatatggtattgcaagcaggtggatcacaaactatatgtgattatagtcagagtgattacgaagataaatataaatatatagctccatgggataggttagattgtagagtattgttttacttaggacaacaagtaaatggtggagccgcaacaattgttttaggggtacttttgtcagcgggtcttttctttgctactatgctgtttaatatgaaattgatgttatgtttgattgcaatttttgcagtaataatgcttttactaattatgatatggttagtttatatatttttattatcgcttattgcactgactattttgatattaatttctccattaatgattcctatggtgttatttcaagctacaaagggattttttgatggctggataagacagttaatggtttatacattatatcctgtaatactttttgcctttctagcattattatttactgtttttgataatttatattttgaggatcttaaatttaagagaaaggaagttaatgttttaggtcagaaaagaattactttcacgttgaatgatccaagagagtgtgatgatccaaaatatgataataatttagcttgtatgtttggaaatatagaatttattacaaagcctgcattttttggatttaatgcctatgctcctgattttaaacatggagctgagatgttatggatgaaattgctcatgatggtattgataggctttttattttatcatttcttatcttctattgcttatatagcagctgaacttgcaggtgatccaagagctggtcatgttggatcatcatttactccaaagtcgatgttggcttctattgtgggtcttgcagctaaagttcagggtagtgtaggagaacaggcaaagaaagctataactgataagttagatgatcgtaaaaaatctgcatctgatgggggaggaaaagatgagctttctggaggaagctctgaaggagctggtgatgctgcagaaggtgctggaggaggtgctggaggaagtggtgctgctagtggaggaggaggataaaaatgtgaagtttctagtaagtgctgatagaagctagaaatactccttattcaatatgatattatttttgatgtttagttatggagaaagggattaagtaagtacttttgttaaagtttggttatttatgaaaattttatcaagatatttgatttaatgtgattatgttatttttttagggtagaagagctgattttatgtttaaaatagttttgataatcagtatttttcttctttcaagttgtggctatcatggttgtattaaaccgcagagtgtactatttgatgaatattcaactactgtagaagctggattagaagatgggaaaaaagaacatgttgcttgggttaaatcggatttggtactagctggaagacagttccttactataaaagttgatacagtgaatgttaatttttgtaataatacaaaagatgtggtaaatattttttctagtgaagggagtactcttgattccagtgctaaaaaatttcctgttaacatccctaatataatgaagggggaaaagttaaattttaggttatctccagctttgaaatttactgtggataaagatatatgtaaaaataacaaccctaaagtttatgttcagaatactagtaaatgcatggaggattatcttgatacggaatattatattccggttgataattacgattttcaaatgaataatctcatgtatttgaaagatcgtggttcagcaaataaagataaggagaagtcctggattaattttccacttaaaattttatatcatctagatagaaaaacatatagagatgtgagtcagatgaatatttctaagttatctagtgatcgttatcaaaataataatgatcttttctatctttgtgttacggataagaggctgaatgaatatgtaactaaaattgtagaagatatgttaaacaaaacatctagtggcaatactgcttattcaggagataaaaaggagcaactaatatcagagaaaaaagaatctctcttaaggaagcgggatgcagttagaaagaaatatcaaaaattatatgatgcgtatactgtaaatatgctatgcggaaatttatgtaatattcctggttatgataaacaaaaattggataaaaattgttttgttgtagaaacgaataatatgcttaatagttgtactattgagaaaagtggtatatcagggtgtaatttaaatgaagcaggacaatatagtactgttttgccttttttatatttaacacatgattcaggtataacgaattttattactgttgatgatgcagttaaaaaatggcaggcagataacaattcttcttctgatattggtcttttgactaatcaccagtattctattagtaaagatttagataaaaatctttatttagaattgcgtgtcaaagatgatttagagttaataggtaagtatacaattgaagtaaccaaggattgtagtaatcacgtcaaggatagtttatattataccatatctaaaggtccacctacagtaaaaccaggagaacaagggactacaccacttaattttataaataatgaagatacaatagtcaaattaacgggtaatgatgaagttggtgaactatattttggtgtaaaagataatggagatggttatgaaaataatacaggatattttaatattacagtaattgcgaaaaagaaaataccaaaagtgatttcatatatggtagaacgattgaaagattcactggaaagaggattatacggaacatcatctactaattctggtggtgttaatataatatataatagtattatagaaaatatgcattttattaaaatagtgaattcattattggtattatatatattaatgaatgcactgttttattgtgctgggttttctaaggcttctatttttgaattgttaactataacattaaaaattagcataataatttatgtgattggtcctaatagttgggatttttttaataatcatttgtttaaattattcactgaagcaccaatacaattaatttctataatgacaggtcaagatcctgatactagtacaagttttgaatttttagatataatcttatatcggttttctttatctgagagttggttacagattttagcattattgtttgctggtccagtaggatgggtaagtgtagttctaattttttggggattagtagttttatttctcactatagcaactgcagttattacttatttgatatctattattcttataggattgttgcttagtattgcacctttctttataatttgtattttatttagacgtactaaagcaatttttgattcgtggattaagtctttggtacagacagctatgcaaccagtgataatatttgcttcttttgctcttttgactcaagttatagataatataatatatgctatgtttaattttgaatcatgtgatgtatgtgtacttcgtcctgagtttgacataggaattacgacaataggtttttgtttacttgaatttttgctccctttaggattctctcctgtatcagtttttactgataatgtaagagattcagtgaatagtgatacagttatgtttataggattaccaatgcctattgttaatatattaatatttgtaataatggcaaatgcgacaaagcattttgttggttcttctggggaaatgtgtacatcaatttttggttcatttgctaatttatctatggtggctgagggtgctaaagaaagtgcattaggcattattggtatggatcaaaatagccgtatgcaaaggtcaaggtatcagcaaatgaatgagatgaataatcaagatagcgatggtgaacgtcgacgtgatcctcttgacttgcattcgccttcaagaagtgatgactctaccaacaggacatcacgtggtggtgtatcaatacctgaaaatcctccatctagtttcggtaggtagagtatgaaaaagtttataatattattactattttttgttacaggatgtggggttaattgtattgagggtagtaaaggtattagtgggaattcagttgttgtggaagttagtccaacagtaaagaaagtatcaaaagtattgcagcctaattggattgacactgaattaagagttagtaaggatcaacctccaatgagggtagcagttactggagcgttaaatatgtgtcccaaagattttttaaatccaaaaaatctaattgttccagcagtttcttgtattagtgatattaaggacatttcttataaagatgagtctacctatcaaaatataaaagatgtgtgtagtaatgcttctttgagaactaaagctgcaaactcagagtatttgtcaggagttgcacacactgttagtgcttttcgattaaataaaggggatgcatttaaagttagtttaattcctcgaaaggtgaaagtaacagactgtagctctgctgcattaaaagaattgggtgtcatatactattctgatgatgaaatttttgaagatagtaattgtcagcaagctattccagctgaaaatatttgtcagaatggtgttcctaaattttatgtgaaagtcaatcaagaatgtaaggaatctggaggaatggctggtgcaatacctcgtttgcaaggtactgaagtttcagcattagtagataatacagatactccttatggaaataagattttttatagtgaagatgcgaaaaagaattggattaatgctccttttgtttatgatgctagaataattaaaaatcaaaaagttaatgttgagacgttaaaaaaacattgtacaattattaaggaattgaatgagaagaaaattataaatcatgttgatactataagtacttctcaatttgaatattatcaaaaacaaaaagctcaaggtgatattacaacagatataattaaagaactgatagatgttattaataattttacaacttatgatataaattgtgtatgtggtactatatgtaattctaaatcaaagcttgttactggtaaggaaattgctacgatatcgaactatggttcagatggaaattgtattattagtggtagttatgaatataacaaagatgctacatttgaagaaattagcaaggcaaaattagaagacattagtaagaatgctaataattctgacccaataatacaaggattgactgctttttttggtacgcgagtaacacataaacaagaaaaagatgcacgaaactattattgtttcccgcagaaagttcagggtggttcgtgttatgctgatatttcttcccaaaatattgattcaaatagcttaaaatctaatattagttatgcatatgattctgatgaaagtgttacgttgaggtttgcagtaataggtgaaaaacaaaaatatgcttcatattctggtgggtataacattcatgtagaacgtatatgtaattttatgtacggaaaaaagttatatatgtatataggagataatcctccaaccatatttcctggtgatccaggtactattgaattatttgtacctgatcctgaaaatccagaatctggaacaggagtgtatatgattaacaaagatggttctgaaaaaaaatctgggaaaatttatttaggaatagatgttagaggttatgaaaatcagtttgattatagtagtttaccaggaattgaatcagctaataaatattttgtggatttttttataaaaagatggaatccaaatttttctaaagtatttgttatgattcgggatttccttttaaggattttgtatggtgtacctaaggatacgcaggttgacaatattgcgcaagctttagatgtggcacgtaccagtaaatcacaaggtgcaatacaaagcatatatgctaatcaaactggtgcaggatcattatggagagcattacaagcgttatgtagtctatatatagtttttacggtattaggatatgcaataggtgttgtaaaatttactaagtatgacttgggagtacggattgctaaaatagcaattgttgttggtttgataagtcaaggtagttgggagttttttagtgatcatttcttttcaatatttattcaaggaacaagtgaccttgtagctgcatttaatggtgaattggatggggataattcatttagatttttggatactactttaggaatattattgacaggagaggtgtggattagattattaacattgatacttacaggacctataggatggttaatattttatataattttctgggccttttttgtattttttatgtgtgttattgaagcaatcatagcttatttattgactattgttgctgtggcttttttagcaacattagcacctatctttataacttttattttctttcaactgacaaagacactttttgatgcatgggtcaaaatgttagtaaatttttcattacagcctataattttatttgctgcacttgcatttttaaatcaagttgtgttaacagtgttatataaggtaacaagctttactgtttgtaatcaatgttacttaggttttgatcttcctactagtgctgttgaagaaggtgctccctatgatatttgcctagtgtctgtgttattacctgtaggatattcacctgatttatctattactgaatcaataagagaatcttatgttcaggggaatggtggattgttagggctaccgtttgacattgcatcagcgttaatattgcttcttgcggctcatgctatgagaggatttaagggtatgtctgagacaattgctcattctatatcagggagcgttgctggtcttagtgcaagtgtatatggtgctactcaggctttagcttctatagtgggacgtgatcaagaaacacaaaatataattaaggaagcaatgcgtaaccgtaaatctaccggtaaatcggatgttgatatcgttagtagaagtaatcctaatcctgaaagtaggggggaatctgtagaaagaagtggtggtagtgattctgatttacctcccaaaggtcatgatggtggtttgcggactggtatttctgataaaggtgataatgtgcctcaacaacctcaatcaggtgatgatattaaagaagatagtaaaacgggaagagctagtgagcagttgcataatgatgtgtcacccctaagtagtagcagcgtacttgatactacaccattcacattaagttataatgaaatgcaaggtgctgataatttagatagtaatccatctgtgactagaaatgatactagtgctgatggtacttcaggaatggattcacaagatgctagtagtgatgcaggttcggaattgcatggtgatggtgatactggtaatgttgctactacacaagatactggtgataatgaaggtgatggtgcacaaaacggctcacgtgataacggtgaaaatgctggtaatgcttcaaatgttactgagcaggatactagtagtggtgagaatgatgaagtacagggaggctcacgtgataacagtgaaagtgctgatgatgcttcaagtattactgaacaagatagtagcagtggtgagagtgatgaagcacagggcggctcacgtgataacagtgaaagtgctgatgatacttcaagtgttgctgaggatactagcagtgatgagagtgatgaagcacagggcggctcacgtgataacgatgagaatggtgatagtactttaagtgttgctgagcaggatactagcagtgatgagagtgatgaagcacagggtggctcacgtgataacgatgagaacgctgatgatacttcaagtgttgctgagcaggatactagcagtgatgagagtgatgaagcacagggtggctcacgtgataacgatgagaacgctgatgatacttcaagtgttgctgagcaggatactagtagtgatgagagtgatgaagcacagggtggctcacgtgataacgatgagaatgatgatagtgcttcaagtgttactgaacaagatgctgattctgttagtgatggtacagaagtaagtactagtgatggagataataatcttggtaatgatcaaagtacagataatactcttgatggtaatgaaaatacgtctggaaataatgatactgatgtacaagaagaagcaggcaaagcttctagtgttgttgaatcttctgatagtgatgatagtgatggcagaaaaagaggaagaaaagatattaactttttggatggtccacaacgtaaaaggctttatatggatgaatactctagtgttgcagaaaaaattgcaggtcatgagtcggcaatagcagtggaagaagaatcatatgaaagaggaattgttaagaaacgtggtaaaaaagatcagcaagaatagaattttggaaagttaagtgataatgataaagagtaaatatgtgtaattttattaaaaagggttttataaaattattattacttttggtaataactgcatgtgaatctaatcaacatccagttcctagatgtgtaccagctgatgtctttactgaaactagaacagcttctgtttcagcatattttgattcacgatcagaagattttattgctgataataagtcattgggaaatattgtaaaaaatgatcaagtagtacggtggaaatatactggatatgtgacagatggtcgtccaattgtattaaaagctgaggggatgtggactgcatgggtcaatgatgttagtgctgaaaaaagtgtaagttttggtgatgaagattcggaacattataatcaaatattgtctgttgagagaatttgtgggccttataataaaatagaaaagacttttgttcctgatggtcatagtgaatgtaaggtatcatgtgaactaatcactggagttaaagatgacttggaaagaggggcatatggacctccttgttggttcaaaaatggatatggtgcatatttattatttaagagaccagatgaccctgaaccaaatgaaacgttggatcatatgagatatccggtgtctcctgtaatgcatataggatacaagccattagaattggctggtagtgatgttttttctactaaaaataaaccaattatgaattccctttgtcaaaaggtgcaattggagccagggtggaagatatatgtaaaaatattagataagtattattatgataatgttgggggatatgcaatcacattccttgaaggtgtaaaaacagaaaaacaattttctgtttttgaatgggttcgtaaacaggtaagaggtgaactagataaagcaggtgaacaagtttttagacatctagttggaaacccgatatttaaaaattttatttttagtgtgttaactttgtttttagtatttggggctttagcttatatttttggtatggtacagagcccatttggtgatattattattagaatattaaaaatatcgttagtaatattattgatttctccaagtagttgggagttcttttataaccatttacttgctttatttattcatggtatagatcagattattgcgctaattaatagtcatacaggttcttataatcctaaagaacctttttcttttctggatgacatgatagtaaataaaatattttctccagttatttggaagataaagatcagagcattaatcatcgctgatttttcttcaatatttgctgtatgtgtaattattattgccgtattcatctacattgctttatgtatgtatggatgtgttatatatctaacagcatttgttggtattacatttttgattgggttattcccattatttttgttaggtattcttttttctcaatttaagagcttatttgatggttggttaacacaatgtgtaagttttgctatgcaggcaatattaatgttcactctgatttccctgtttggtgcacttattatgaattattattaccgtatttttgggtttacgacatgttataatgagtggctgaaggtaaagatatgtgtattaggtaaaattggatgtatagttgatcaaagtatttttggatggactccagggcaaacttatgatccaaaagttattggattgacaacagattttaatcttaatgatcgtaagtcttctggtagtgcaagatataaatttactggtggaggtgcatatattgatgttcctcctgatcgtaagcataaggattttagatacgtagattatccttttcttgatccagatgctaaaactgatgggaatccgtttggtgtgactgtatctcaagatagtccgtttagacagttatcttattatattaatgcattactttcttctaataaaaaatatgtagctgcaaggttggtaaaggatatagaagatgagttagatgttttagaaaaaaacggtactataagcttgaacagtaaaaataaagttttacaaattatacagcagagaagaactaaagataattctgagaaaaaaagtgaattagagaaatataaagatgaggattttaaatctcaaataattgatagtattattgctgatgttatagggagtgctgctcaagaacgtactcctcaggaagaattgaataagcaatacgattattggttaatcttaagggttagggctggatatttaatattctggacagaagttggttctttattattagctgcgttattaatatggcagatgcgtgcgtttgttcaaagtgtagcagtatctctagctggcggtaatatgatgtctcaaactattgctagtatgtatgaaggtggattcatgaagattttttcaggaattccagttgtaggtgttgtgttccaaaagattgatcaaggtatagatggcttaaaatttgcggtaggtaattacattactgcagttgctcgtatgcctttaaatgcgttaaagagtattccttatctaggtgcagctgttaaatttactgctggtgttactggtgcattgacttcttcatataatgaatatgataggagttttagtaataactttaagcggttaaattatgctcgagcttttataggtgctcatttaggattttctccgttggatgcattgaaatatttaggtggtcatgttgctggcaaaatgcttggtaatagggatggtggattaattcacaatgcaattgaagatcgtaaagctgctttggatagtttgaaagcacatatattaggacctgagaaacatagaccaagcccttatattcctaataaaaagaaagaaacagaggatgatgatgcaaggaatcctttttctaaagaaacagtaggtaacaaaagtggtactgtatcaccagatgaatataaaggtggtgataagaatcatattattagggaaggattacgtagtgaagctggtagtgcattatcagatgattataaagatggtgataagagtcatattattagggaaggattacgtagtgaagctggtagtgcattattagatggatataaaggtggtaatgggagtgatattattaaaggaggattacctactgaaggtagtacattattggatagatatgggaatgtatgtgtaagtgaagggaatatagagcatgcacttgaagtaagagagcagcttaaaacaatgcttgataatgctgaaaatgacactgcgttgcaaactattcagtatgattgtgatagacttgataatgctttacatgaatatttaggtgataagtttgatgatgttacacagggttacgctagttctcgtgatccaatgggtcatcctcaagatttaattactgaagatttatctaaaattagtgcttcctcagattttcgagatctgaatgctatagatttaggtacacaggtgcaggtaggtagtgatataggttcagatgtattacaacagggttcggcagatggtaatcgaagtgaagttgaagtatcaatggatatatcgaaacgtgatgcgttgttggagcaaatggaattaaaaggtatggaagcagcatcaggtactgaggcacagctatatgatagtgctgagttaagtactcctttagatgttacatcttctattaataatgtgtcttcagaagtatcacaacaagatttagcgagtaatggtgaaattgaagtatctctagataaagatctggaattgaagaatttagatgtggtatcaggtgatattccagatgttgaagttacctcaagttcagatgatgtgacacaaatatatgatagtgctcaagatagagattcttgtttagatattatatcttctgcggatgatgcaagttcagaagtatcacaacaagatttagcgagtaatggtgaaattgaagtatctctagataaagatctggaattgaagaatttagatgtggtatcaggtgatattccagatgttgaagttacctcaagttcagatgatgtgacacaagtatatgatagtaccgaagatagagattcttgtttggatattgtatcttctgcagatgatacaagttcagaaatatcacaacaagatttagaaggtaatgatggatatgaaattgataaggatatgggatcctcaaacgaatcaatgctagatgaaattccaggaggatttgctgatgttatacaagattgtagtgatgctagtttaagtactcctttaggtatgtctgcaagagatgatactgatgctacagatactgtagaggatccaaaagaaaatgtgttaccgcaagatgtagatttagaagatttggacacaactcattctacgaatgatattgcagattttagtggtgaaagttcattatttgatgctacttcggagtcagatagtgctgcatttgtaggtgagcaaagcattgatttcagtaccgaggaagggagtgatttaccttcggaagttgtagcgcagcatgatgtagattcacaagattcatcagtatcagtaagtgatatggctgttgcggatatggaacaaggaacagaggattctaaatacaccgatgttgatggtttgagtgatagtgttttagatttaggttatttagaaggtaatgtagataatcctgatattgagcctgaacatgatatgtcacagcaatatagtacagagactgaagaactcagtgatatgctatctgatgatgtgatagaaccagaaggagtaagtgaaactgatactcaggttgatagtgaagaatctcaagatgacagtggtactgcaggtcaagttgaggatgaaagagtacatgatgaagtaccttatgatactcaagatagtacatcaggagataaaggtgatattgcagaacatgatgataaagatggtgttgtagaacatgaggatactgtagatcaaagtattgacgatactcatgaagaagaaggtaagtttactgaaggaattgtatctgaaagtgtgacagaaccagaaggagtaagtgaaactgatactcaggttgatagtgaagaatctcaaggtgatagtagtgcttcggatcaagttgaagatgaaagagtacatgatgaagtaccttatgatactcaagatagtacatcaggagataaaggtgatattgtagagcatgaagataaagatagtgttgtagaacatgagggtactgtagatcaaagtattgatgatactcatgaagaagaaggtaagtttactgaaggaattgtatctgaaagtgtgacagaaccagaaggagtaagtgaaactgatactcaggttgatagtgaagaatctcaaggtgatagtagtgcttcaggtcaagttgaagatgaaagagtacatgatgaagtaccttatgatactcaagatagtacatcaggagataaagatgatattgtagagcatgaggatactgtagatcaaagtattgacgatactcatgaagaagaaggtaagtttactgaaggaattgtatctgaaagtgtggcagaaccagaaggagtaagtgaaactgatactcaggttgatagtgaagaatctcaaggtgatagtagtgcttcaggtcaagttgaagatgaaagagtacatgatgaagtaccttatgatagtcaagatgatactcaagatagtacatcagaagatgaaggtgatgtcgtagaacatggtgataaaggtgatattgtagcgcatgaagataaagatagtgttgtagaacatgagggtactgtagatcaaagtattgacgatactcatgaagaagaaggtaagtttactgaaggaattgtatctgaaagtgtgacagaaccagaagaagtaagtgaagctgatactcaggttgatagtgaagaatctcaaggtgatagtagtgcttcggatcaagttgaggatgaaagagtacatgatgaagtaccttatgatattcaagatagtacatcaggagataaaggtgatattgcagaacatggtgataaagatgatattgtagagcatgaggatactgtagatcaaagtattgacgatactcatgaagaagaaggtaagtttactgaaggaattgtatctgaaagtgtgacagaaccagaagaagtaagtgaagctgatactcaggttgatagtgaagaatctcaaggtgatagtagtgcttcggatcaagttgaagatgacaaggtacatgatgaagtaccttatgatagtcaagatgacgtagaacatggtgataaaggtgatattgtagcgcatgaagataaagatagtgttgtagaacatgagggtactgtagatcaaagtattgacgatactcatgaagaagaaggtaagtttactgaaggaattgtatctgaaagtgtggcagaaccagaaggagtaagtgacgttgatactcaggttgatagtgaagaatctcaaggtgatagtagtgcttcggatcaagttgaagatgacaaggtacatgatgaagtaccttatgatagtcaagatgatactcaagatagtacatcagaagatgaaggtgatgtcgtagaacatggtgataaaggtgatattgtagaacatgagggtactgtagatcaaagtattgacgatactcatgaagaagaaggtaagtttactgaaggaattgtatctgaaagtgtggcagaaccagaagaagtaagtgaagctgatactcaggttgatagtgaagaatctcaaggtgatagtagtgcttcggatcaagttgaggatgaaagagtacatgatgaagtaccttatgatgctcaagatagtacatcaggagataaaggtgatattgcagaacatggtgataaagatgatattgtagagcatgatgataaaggtggtgttgtagaacatgaggatactgtagatcaaagtattgacgatactcatgaagaagaaggtaagtttactgaaggaattgtatctgaaagtgtgacagaaccagaaggagtaagtgaaactgatactcaggttgatagtgaagaatctcaaggtgatagtagtgcttcggatcaagttgaagatgaaagagtacatgatgaagtaccttatgatagtcaagatgatactcaagatagtgcatcagaagatgaaggtgatgtcgtagaacatggtgataaaggtgatattgtagagcatgaagataaagatagtgttgtagaacatgagggtactgtagatcaaagtattgacgatacttatgaagaagaaggtaagtttactgaaggaattgtatctgaaagtgtgacagaaccagaagaagtaagtgaagctgacactcaggttaataatgaagaatctcaaggtgatagtagtgcttcggatcaagttgaggatgaaagagtacatgatgaagtaccttatgatgctcaagatagtacatcaggagataaaggtgatattgcagaacatggtgataaagatgatattgtagagcatgatgataaagatggtgttgtggaacatgatgataaagatggtgttgtggaacatgaggatactgtagatcaaagtattgacgatactcatgaagaagaaggtaagtttactgaaggaattgtatctgaaagtgtgacagaaccggaggaagtaagtgaagctgatactcaggttgatgaaacacttcaggatttagaacatgaagatcttaaagagggtgctgatgatatatctgatagtgaaacagatgaaaatagttcaggaaatagtgatagtgtatccgatgttgaagggttagctagtttagcatctattggtgaagaaagtacgataactcaaaatgtaaaaacacaatctgtacagtctagtgctatattatcgatgaaagatagggacggagttctagataataagggtattccaagtgatcaattggatgttaaagatacagaaaagaagaagaaagaatctagcaaaagcaaagttgagaattctgataaaaaagcaaagtcaactaaagcaactgtgactccaaagtctttaaagaaaacttttaaagtaatattgagtcaatgtacgcaagaattatcaaataaattatctgaagcttttgataagttatttatagatcctcaaagtggtaaacaaaaacgtagattatcaaaacaagatattgcattaatgatagagcagcttaaggcaatgatagaatcattaaaggatagaaaagcacaggtgacagatcctgatgaaatgaaagcgatagaagaaagtattaaacaagcagaatctacaattcagaatttattgaatcaggaataattccactatcataagagagttagtagtattttaggttgaatagagagttaagggaaatttatgtttatttattatataaacttctataaggcagtgtaaagtaacttctatatgtaaatatattaaagattatatcaattttagcataaatctaaacttttacttctatgagtgcaatattgttgcaattatattctttataattatttatagagtatggtaagtaatctgaatcaaatcttacaggcacatcaaattcgtaatctacatgtatttttactccattatgtggtggattgttgaactctatttgaccatttaagaaatttatagaaaacccatcggcttttataatgttattgtagtaaatttttactgtattcataactggttttgtaattatacgtgtgtatgagtattgatcgatactatatgttttgattatttgaaaatttttttgctgatcatttcctataccaatttgttgtttttttgctttataatctagccaatctttaaaacggaatccaatagctttacctttatgaatgtaaaaaaaatgaattaatcttactaattgatcttttgattttgtgttatacattacattgtatttgttgcgtgggtatgatagattgattctacgatattcacttccattatttgtttcaataatgtttgttgaaaattctggtccaccagttgacccgtaagaaatatcttctggaaatcttatttcatggaatgtcattgttattgttagttatgtaaaatgtattttaaaattgtaggtataaagatacttttgtactgattatttaatgataataatagtaattaaacatcatgcttattgttctagatattaggattacacttttataatgaataatatgctaggtataggtattatatatgcatgttgagatttatgtaatcaaatactaaagaaaaacttatattccagttgaaccaaatccttgggctccgcgttttgttttatcattgtcaaaatcttcaacgagatcccatgaaatacgcgttattggagctattatcatttgtgctattctatctccgtattttatagtatatgcttcatttccaagattaattaagataactttgatttctccacgatagtcagcatctatagttcctggagtattgagtacagttataccgaatttaagtgccagtccagatcttggtctaacttgagcttcatatccattaggaacagaaattgcaataccagtattaatgcacactctgcatcctggttctaatataacgtctgtgacaactgctgaatataaatccataccagaactattatctgttgaatatgatggaagaggcagattatttttggttaacttaataaccttaattgacatgtttggaatgatagaatgctccatgagtttcctataattgtgattttaatttgtattattcaataaatctattaccaagtctaccatgaatatatataatgaatagagtaatttttttaatactggaagtgcaagatagaaaatttaccattgtgaaaatagcagatatgttatagtttgtattctcttaattgttttggtatattgaatgcaacgttctctcttataacttctaaatctgataacttgatattcatgtgctgtttcagtaaatctattacttctgtgattagtatttctggggctgatgctcctgcagttattcctattttgtttacatcttttaaaatatctaagttaatttcctgataagaatctattaaaaaagcaggagtttttaattcagctagttcttttaaacgatttgaatttgaactattcttgcttcctaatacgaatatgatatctactaattctgataattgttttacagcagtttgcctattttgagtagcataacagatatcctttaaatctggccctttaatatttgggaatttttgttttagtttgttgattatttcttttgtgtcatctacacttaaagttgtttgtgtaacatatgcaagtttatctgaatttgttacttctatattatcaatgtcagataggttttgtactaatagtacagggttggttatttgtcccatagtaccttcgacttcacgatgccctttatggcctattaaaattatttgatatccttttttatcataagcttgcacttccttatgtactttatttactaatggacatgttgcatcaataatctctaagttgcatgattgtcctaggtgttctatttcttttgaaataccgtgtgcactatatattaatattgatccatcttcagcttgatctaatgtatctataaaaattacacccatttcctttaaggaattaattatatatttattgtgtacaatttcatgtagtacgtaaacttttctattgtcactatggtattttactgctagctttacgatttctattgctctagaaactcccgcacaaaatcctcttggattagcaagtatcacttcaacatttttttttaaattttgatgcacttacatacctaactttatctacctaattatatattgataataaaatattgcaatatacaagttatagtaatgcccaatagtagcaatgatattccatttggtcttatgtattaaaagttctggttttattgtaaattagtagattagagtttgaaaaatatgttgcttgttggaatttacatattgtaatatagcagttataaaagtaatattgcttttagataatgtaatttgaaatagggttttgagatttcaataatagcaagataagttaataattaaactttaccgttagtgacgttttaattgtctaaacggtaatattcttaatattaataattatcaatatattttccttgtttatcgtataactgttagatacctaatattgaatgaactgtaattctgatatgtaagttatcgttttaaagttgagggttatgttatagttaagatatagaactttaagtatgttcataaaacttactaaacctgaaagtataaaccctataaggttcatataaaaaagattttatattttaatggtatataaggaggttttagtcattttctcttattaagttaataaaatggttaaatatataacttgcgtcattaggtccaggacttccttcagggtgatattgcactgaaattataggataatcatttacttgaataccttctattgtattatcaaataaagatctatgagttacttgaacatttgtgggtaaagaatcttctttgacagtaaatccatggttttgacttgtaatttctatgttattatttattttattgtaaacagggtggttgcttcctcgatgcccaaataacattttgataatttttgctcctaaagctaatgaaatgagttgatgtcctaaacatatgcctaatattggtattttagattcaataatagtttttatttgttttatgatgttttcagggattgcagatgggtctcctggaccatttgacaaaactatgccttggggttttatgaataataccttttcagataaattatcttcatttcctgaaatcatgtgaattttacatcttagtttagataaagcatctagtatacttagttttattccaaaattaattactactatgttatagagcagtgtatcatcatctgttgagttatagttgtttacaaatgatatagatgaacaatggtctctataattgtattgagaagcttttttttgtaattttgctaagtttattgagttgatgttatcaaagtgatatattattccgttttgtgagccatgctgacgcaaatgacatgtcaatgctctggtatcaatttcagagattccagttagattattttctatcatccagagttctaaatttgaatatgaacttgagtgggaatcttctgatattgttttcactatgatcccgtgggttaatattttgcgatcttcgaaatctttgtaatttattccaacattgcctatgtgaggaaaagtaaatgtaattatttggcctgcaaatgatggatcagttatagtgtgctgataccctgtcattgaagtagtaaagcatacttctccaacagtggagattttctttcctattgattttccaaaaaaatgttttccatctgataatacaagaatagaattataataacttgttaattgggacattgtttacataataaatctaacaaatctcgagaattatatagcaaattctttgaaagttaactatataatttacttttatgaggtttgttgaatgtgtatttttacgtattatctatgatttataaatttgataatatgttatccataggatcaacagtaatattgtgctatactcaataactttaaataatgtctggctgtatagtatatcataagtgtagaattttttatgttgaaaatagctatagttgggttacctaatgttggaaaatctactatttttaatagattaactagtcaaaaatctgcaattgttagcaatattcctaatttgacaagagatagaagggaaggggatgctgatttatgtggattgaaatttaagattgttgatacgggtggagtggataatacaataaaattatcttcattagtactcgatcaagtaaaattatctatagaagagtctgatataatatttttcgttgttgatgcaaggattgaacatgatgataaaaatatagagtttgcaaaatatttaagaaagaaggtaaaaaaacctataatattaattgcgaataaatgtgaaagtcaaaagagatgttatagtatagattatttagggtattttgattttataggtccagtttatatttctgcagaacataatttaggtttagtggatttatatgaagcgttgttgccatttattaaagaatatgatttaaatacattagatttacataatattaagctttctattgttgggagaccaaatgctggtaaatcaacttttattaataggttgcttgctgaaaatagaatgattgtaagtcctgaacctggaacaactagagattctatagatgtagaatatacatatagaggtcagaaatttacattgattgatactgctggcatgcgtaaaaaagcaaaggtaactgaaagtatagaagtgacttctgttcacaagactattgagtcaattaataggtctgatattgtgattttgatgatagattctgtttatggtatagagcaacaagatttatctattgctgaacttgctatacaaaaaggtaaagctattattattgctttaaacaaatgggatatgattgctaaaaaagatagatctgagttgctaaaagatatttgtaattataataaattgaattttaaagttccggttattgaagtttctgcacttaaaaatattaattgtaataaaataatagaaacaagcatagagctatataaatgtctgacaatgcgtattagtacttctgtgctgaataaatggttaaaattagctgtagaataccataaacctccattgtgtaatggcaaggtagtgaagatcaaatacattacacaagttaaagtaatacctccaacttttattgcagttgttaatggttcttatagtattgatttaacttataggcaatatttaatgagtagtttgaggaagcatttttctattgatgggattccaataaggttaaattttaaaaagaataagaatccatatgatgatagttattctaaatcttaaagcaatttcttaattgaatgtgttaagattagtatcaatgactttgaattttattataattttatatgtattcaatcaatgaaatacctgtcatttcctttggtttttctatattgagtatttctaagatcgttggggctacatcgcataatcttccattttttaatctaatttgtttactataattacaaattatgaatggtacaggatttaatgtatgtgctgtatatggcatattgttttttacatcaaacatttcttctgcatttccatgatcagcagtaatcactaatacataattagtaccttgtatacagtttaatattttatttaagcattgatctagagcagttatagcttgttttgttgcttctatatttccggtgtgtccaaccatatcagcatttgcataatttaaaatgattaaagaatatttttgtaattttattctttcaataactgtattagtaacttcttttgcagacatttctggcattaaattgtatgtagttacagaaggtgatggtattataattctatcttcattttcaaacgtgtcttctctaccaccattaaaaaagaaagtaacgtgtgcgtatttttctgtttctgcgattcttagttgatgtaatttgtgatttgctatgacctctcctaatgtatttgtgatgttgttgtttggaaataggcatgggatattaatgctttctgaatatttaaccatacctattgtgttttctaatgtaatatgattgtcggtttttatatctcctataatcatttttataatttgtattgctctatcacttctaaagtttgtcatgatgaacccatcttgtggattcatcccattataatcaccaatcacgcacggtaatataaattcgtctgtaataccagcattgtagctatcctggatagctaatgatggatctgtataacgtttagcatctgcaaatgccatggctttatatgctgttcttgtacgatctagtttgttatcacgatccatagaataatatcgaccacttattgttgcaatgtttacattatttaaatgtttgatatgttcacgtaagatattaatgtatttaattgctgatattggaggagtatcacgtccatctaaaaatatgtgaactgctatttgtatctgaaaattagataatgtatcaatgatatctaacatatgtgtatgaagagagtgcacacctccatcagatagcagaccagctatatggcatatcccattgttttgctttattttttttatgaattctaataaataacggttgttttttatatattttatttcattatttattttgcatagatcttgtaaaacaatcctgccgcttcctaagttaacatgtccaacttctgaattacctatttgtccatctggaagtcctacatttaatccatgagtaattaattggctttttggatattgtagaattgtattatcccagcagggtttgtaagattgagcaatagcattgaattgactattttcgctattaccccatccatctaatatgcataaaattacagaatggttagtcatatgttcaatgaaaaatttcactattatatgttatatcatagttgctaagatatagtagatatatttttagagtgaatgggaatatagtaattatattaatctatttttatattatgatattcctttaagaattttagtttaatctttgaaaatctgtaatatttaaattaatatgtgatttatagtgcgatatggtggattttgtaataatggtatgttttgacgtaataaatagtgtattgagtatagtgtagaaatactcgaataataattttgatgagtaaaatacattatttaaaagtgaagtatagattttgttatgctgggatattctataaaaatttaagtactgaaagcagagtattgaatacattgataggagtagaacaatagctttacaacttaagattttaaattgcaacataggttttgctacgattatatgttgtgtaaaacatttgagatatcagaagaatatggagattgaatacattgttaaagtgttaatgcatacttgaaattaacgattgtatgattgagaattttgcaaagttatcatttatataacaatatagttaaagaatgaatgttaattatctgatatactagttttatttattatattaggtttaaagtttttaatagtaaaagtgtaataagtagtattattgtatgcttgtgtttagatatataaaattaatttcagtgaaaaatgtagaatattttttaaaaggtttgacaattttgaaaagtgttcatcccgtaataatgtaaaagtagttgatttctttttgtaagtaatatagttagtttagtaatgtaataatttttgatatataaatgataagatccagtattgtactcttaattgttttggttttctttaaccctatgttgttattggcaagtgaggtaatagaagaacatgatctatataaagctagtgataattatgatgttgagcatattaaagatcatgatgttcaatatgatagtttgataagcaaggataagatttctttgaaaatgcataaaaatgctattcctgtgtttgttggtaataagattgtgtttttagctaaagatggtgtcttgcgttctgtagatagtgggaatgttaaaaaatgctattgggaattaggaattacaaaacatactaatttgtatagggcaagtatattatactctgaaaatatgatattttatatagcagatgataatgtctattgtattgattttgaaactggagaaataaaatggcagaaagaattaaggagtgtgattgctggatctcctgttattattggaaatcatttaatggttgttactgtagataattgtttatacttttttaatgtgtctgatggatcactaatatcaagtaatcaggaatcacttcctgaagtaaaaagctatagttcgttgtcttcagcatcatatggtgaaacagttatattctctttttctaatggaaaaattgctgcatttaattctttaagtggtttaaaaatttgggaaagcgatgcatcaaatactaatgttgcatttgctcatggaatttctttagaggcaacaaatggtactgtaattgctgttgataaattacatagtatatcgaatattgatattgagtctggtaaaaccagatggtcaaaaaatttaaaagttaaaggtatttctaaaattgaaagaggtaatatagcaactgtgatagacaataaacttgtgttaatggatatcagtacaggagattttttatggcaatatgacttgttgcaacatggaaaacctaaaaatcaatggaatgctcctattataatgaatgatgaagttttagtcataggagatgatggctgtgtggtattaatagattataaatctggagctttaaaattaataaatcatatattaccatcaacttattatgttccagtgtttgtaaattcttcgctttatgttgtaacaaataagggtaaggtagttatttttcattgaatgatactataaggtataaatatgcaaaattatgatatggtagttattggtggtggtcctgggggttataagtgtgcaattagaggagctcaacttggattaaaagttgcatgtatagataaaaatgaaattttaggaggtacatgcttaagagtaggatgtattccttctaaggctttattgcatttctctcatgagtattatcatttgaagaataatttatctgaagttggtataacatttgataacttaaattttgacttagaaaaaattatgtcttttaaggataaaaacattgctgagttaggaaatggtattagttatttgttttctagccataaaatagattatttatgtggtgttggtaagatacagtctgtagggcctaataattttattattgttatatctggaaataatggtaagcaggagataataagtaggtatgtagttattgctactggatctgatgttgcaaattttcctgatattgatgaagaaagagtagtatcttctactgcagctttgtcttttaaggagccaccaaaaagattaatagtcataggggctggggctataggcttagaaatgtcatctgtatggagtagatttggatctgaagttactgttgttgaattttcagataaaattgctcctagtatggatggtgatattggtaaagctttgcttacaagtttaaaaaagcaaggaattaattttaaattatcaacaaaagttagttcaattgacaaaaaaggaagtaatttagctgtgcatcttgagtctgtgaaagatggtaagtctgaaataatagaggcagataaggttcttgtatctattgggcgtgttccatatacgaatgggttgattgataataattccatagaatgtgatgctagaggatttattaaagtgaataataagtatgagacaaatatacctggtgtatttgctattggtgatgttattggtggagcaatgcttgcccataaagcagaagaagaaggtattgctgttgcagaattaatttctgggcatgttccacatgtggattatgaaattattccatccgtaatatatactcatcctgctgttgcatcgattggtaaaacagaagaaagtttaaagaaggttaattatagttataatgttggtaagtctaatttttctgcaaatggtaggtcaaaggttacagataatgtatcagggtttgtaaaagtattggcttctaaagaaaatgatgctattttaggtgttcacattattggtgcatatgctgatactatgattaatgaagctgcggttgctatggcttatagggcatcatcagaagatatattccgcatttgtcattcacatccagatgttaatgaagcatttaaagatgcatgtgaagcagcatttttaaagtgatttatgaggtttaagtattgtgttgcataagctattaagagtaaagttacaatataaaatagcatttgtaattctattattagctattgtgtggattagtagtggagtattgaaaaagtataatcagcaaaaagaagaaggtgttgttattcatgataattctcctaacattaaggtagtggagtctaatgctcaagatagggtagtatatttatctttaacaggtgaagtagaagcttttcgttatgttaatattgtaccagaagttgctggtaaagtatcagatgtattagtaaaagatggtgaatatgtaacagaaggaaatattttagtcaaaatagaaaaatatgaaaaagaagaacaattaaaacaaactaaagctctattaaagcaaagagaacttgaatataaagcttcacagtctttaaatgagcatggatataggtctgagataaatgatgcattatcttttgctgctttggaatcagctagggcagatgtgaaaaaagcacagattagtttagagagtacggagataaaggctcctttttctggatttgtagataaggtgaatgtacaagttggtgagttagtatctgctagttcaggattatcagtactacaattagttaactttgataaaataagagttgttacttatgttccagagaaatatttaagcaagctaaagttaggtgatgtttgtaaggttttaattgcaaaaaatgaggaggtagatgctcctattgtttttattagcaaaataataaatcgtagtacaaggacttatcggatagaaatggtacttgataataatgatttaaaaatttttacccaaggcgctgtttattctgtaaaagttcctatagggagttatagagctcatagaatttcaccttctgctttagatttacaagatgatggggatttgggaattaaagtgattgttgataaaagagtaaagtttatacctgttgaggttattgatagtgaagacaatggtgatgtttgggtagctaactctcctgatactattcagttaattactttaggtcatgagtatgtgaaagataatgcgtatattggtataaggtaataggaaattaggtttaatctgtcataattctgcggaattagtaaattcaagcgactttataagttagtataactttttcagtattataaaaattatgttgcaggttggtattgtgtattctacaatgtaggaagttcattgtttataaaatatagtggtaacaaaagaaggtataattgaagctgaaggtattgtaattaagctattgcgtgatgcaacttttatggtgaggcttaatgataattatgaaattatagcacatgcttcaggaaaaataagaaaaagtaaaatacgtatactaatgcatgacagggtgttagtagaaattagtacttatggtattaataaaggtgaagtcggaaaaggtagaattattagacgattgaaagttacagatgcttaagtttgataatttaatattagcttcttcttcagagcaaaggttgtctttattagaacagattggtgtaattcctggacaagtagtatctcctgatatagatgaagtggttttaaagaaggaattaccgaaagtttattcaatacgtatagctaaagaaaaaggaacaaaggtaagggtattatatcctgataaatttatattaagtgcagatactgttgtatgttgtggtaggcgagtattgcccaaggcagaaacagaagaacaagctcttgaatgtatacgattaatatcagggcgtagacatagagtgtatacaactgtttgcttatatactccttataataaattgcattgtagaaatgtgatgacaatagtcaagtttaaacatttatccatgcaggagatcaattcttatataatgtctggacaatggaaaggaaaatcaggagcatgcagtatacagacaagtgctggtaagtttgtattatcaattaatggatcgtactcttctgttatagggttaccattgtatgaaacttattctattttgagtcaatattttagtatatagattcttagttatagttattgatgtagtagatccaaactgtagttataagttgctattaatggtgtgactattttgtattgtacgctaattatagtgctgtaattgatgataataaatttcttgctaagaatagtagcaattgctaacatggtaagcatttaaagaataatttgttgataggtattttaaaatatattgattatatactgtctgttgagttgttcattaaaattgtatttcacacatgatataacataatggtcctgttgtatttagcaggttgttatcatggaggggtaactattatgaaattaggagaatgaaatggttaatttgccaaaatttacaatgcgagatttagtagaatctggtgttcactttggtcataaagcaagtagatggaatcctaaaatggctccatatatatatggagtgcataacgatattcatattattaatttgcaaaatactgtagttttacttaagaatgcattgaaagctctgtatgatatagttcttaagagaggtagagtattatttataggtactaaagttcaggcttctgctattattgctgatgaagcagtacgttgtggacaatattatataaataatagatggttgggaggtatgttaacgaattgggaaactatctctttatcaataaaaaaattaaaggaatatgaaaaattaatagaaaatgttgataatcaatttacaaagaaggaattattactttttgagaaaaaaagagcaaagcttgataggtctataggtggtatttgtaatatgggtggattaccgcatgctttgtttgtaattgatacaaataaggagcatattgcaattaaggaagctaataagttaaatattcctgttatagccgtattggatactaattctgatcctgctggtatagattatccaattcctggaaatgatgatgcagtacgttcaattgatttcttctgtaaaattgtatcagatactatattagaggcaatacgttctgatttagctaaatctggaattaatgttgatggtattaaggatttttcagtagaaaaaagagaagatcttttgagagcaaataatcgagatcataaaaacaataaaaataatagtactattgataatgctgaaaatcttaaggaagaaaatctggtaggaggaagtaataatgaaagttgatattaatgcagtaaaagaattgcgtaatttgacaggtgctggtgttggtgattgtaaggaagcattaaattcttgtggtggtgacatagaaaaagcaaaaaattatcttagggagcaaggtattgcaaaagcttacaaaaaatctactaaggatgtatcagatggtttagtagcagttcatgttaatggaaaccaaggcgcaattttagaagtgaattcggaaactgattttgttgctcgtaatgaaaaatttcaaaaattggtgttaaatcttgtttctttagctaatcagtatgctgttgaagatatagaagattttttaaaacatgaatatgttagtggaactagtattcatgatgaaattatgactaatattgcagtaataggagaaaatattcatcttaataaaatagggtacttatctgttaatgctggtgttgtaggtgggtatatacatagtcctgtggttaataatcttggtaaaataggagcaatagttgctttagagtctactgctgataatgacaaattaaatgtacttgcaagacaaatagctatgcatattgttgctgcaagaccagaagcattatctgtggatcttttagataaagatattttggataaggaacgtgaaattataaagaagcaggtcgaccaattaaataaaccagtgtcagtagcagaaagaataatagatggtagaatagctaaattttaccaagatgttgttttattagagcagatctttgtgatggataatcaattaacaatttctgaattaataaagaaaaaagaatcagaattgggtgcaagtattaatcttgtagggtataagctatttgtcattagtaaataatgctataaaggttagtatttttatagtttaaatttgtaggacatggtaggtatactatcttagttgtttatggcttgtatacaatttttatgtagttagtgtattttattatagtagctgtataataatttttatacagttactatgtataatgctttttattaggttaactgtattttgctttgtattaagaattaacattgtgtatgtatttcattatatagttgacaatctgtattctgtagcatgaattatacacgtacttttatatattgcagaatatatattaaaattgataagatatttatgtgttttttgtaaagcattaatttataagataaagaatattgttaaatgagagattatggatattacgcctattatttgtgctaataaaaatgtaattactggctatggtacaggtgagttttttataaatgataatgtctatttggggtctcacatagtttttccaaataaaattatttcttgtttagatcttaatatttttaacttagaaaatataattgaattattggatgaaactttagatatagtattaattggcactggtaaaaatcatatatttttgcctaatgaagtgaaaaacaattttttaaaacgtggttttaatattgaatatatgtctacaggagcagtttgccggacatataatgttctattatatgaagatagaaatgtttgtgcagcgttaatatcattataagttcttatgttttttgaaattattaatgaatatttttttgttaatggaataattgctatattaattgtgagcttagtgacaggatcactagggtcatttatgatatggaagaatctttcatatttgggggatagtatttctcatgcatctatcttgggtgtagctttagctgtattgttggatattagtatatctagtggaattttatgtatttctattatttttgcgttgttgttgtcttatagcattaataaaatctattctatagatacggttttaaatattgttactaacgttattatgtcttcaggaatgatattgttatctttcttcccatctgcaagtaataatattatacattcgttatttggggatgtactaatgttaactaatagagatcttataataatggctttagtagcattggtaattattactcttgtaatatatagatggaaatattggttaattatatctgtaagtaatgatttgtctgcatctgaaggtgtgaatgtaggttttataaaattagaatttctagtgatattatctgtatttattgcttttgcagctcaattggtagggatattattaattactgcttttttagttattcctgcagcagcagcaaggttgatgtcaaaaacaccactacaaatgatagtaatttctacaatcatttctatattttctggtataacaggacttctattatctgaaaaattcgatatttttcctggtcctttgattattatggtgtcattcctatttttattagtgatgtactgtattaatagattaatagattaatatttatatttaattttagtactagggtagttttttttaaaaattatgctagaattagtataatattataaataatgtaagtaatactatgtcatcttttaaaaatttaattatccgtactactggttttgttataggttctctattattgatatttagcattaatatgttaatgcgacgttgtagtaaaaggagtaataatgtttctatagctgtgattttattgtttagtattggaattactgttttttttcaaatatatggtaggaatgaacattcattaacatttgttaatattaaaatgtatgtgatgctattggctagtagtttaataatgttttgtattgctaatttagtgttgagaaaagaaagtgaatgttattccaaatttagagagcaaaataagaaaatttattttttgaaaattgatatagctaatttagaaatacaacttaatattatgaaaagggaaatagaatggttttttgataatttatgttctgatactaaaatttgcgttgatataaaacaagagtacttattgccagctaataagaaattttatgatattggttttttatgcaaaacagcaaaatttgttacctttagtatagcattagtagtatttttgtgtgagtctttttatagtgttcttagtcagaaatttgatttggttggattatttatgtattatgtgttaatatcattatttctgtttacatttataatagatcggttagctctttatagtgaaaagaactataaatctatcagtcagaatagtaagagtattattgatactttaaatactgaattaaatgtgaaaaagagaatgtatactgttttattacaagaagtctcaaaatataacatacttactgagaaagaattagtaaatgaaaacaatattcgtacattagaaaagtataaaaataaaatatttgatattttagatagagtttaatacacattactcaatttaattgtaaagtgaaaaaatgtattttataataggtgatctcatataatttttttatactgcatagtttaattttataaaatttttgattgaagatatataaatgtttgcataattaacattttagtttactatttcactctgaacatgtaacttacgtaaattatatagtatacgttaaataatgagagaaattatatatgtaagaattaagagtctatagggtttgtttatattgatactttactttttatcataatattatataaatctgtttatgtaagcagtgtatgaattgaaatagctatataaagtaccttacatagttttgtttgatagtatcaaagttaaaaagtagtataatgttactgtataaaatgggtagtaaattaataaaatgtacttgtataacctgatattgcttttataatgtagcctagtgttatgcattttagtattatctatgttgtaatgttgaagggtaattatgaataatgatgaggataaatactctgtatttaagacaaaagttaaaagacgagattttttaggcttgactactttatctatggcaggtattgggttgttttcatcagtatatcccttgataaaatttttaagtccatctgcagaagttatagcacagtctactgttgaagtaaatttatcagatattaaagaagggaaaactaaagttataaagtggcaaggtaagcctgtctttatacgtaaacgtactacacaagagatagaagaagccagagctgtaaaaatagatagtttgcgggatccacagtctgatcaagagcgtactcatcaaggaagggaagaatggttaataatggtaggtatttgtacacatttaggatgtgttccagttgaagtagatgatggaaagaaaggttggtattgtccttgtcatggttctaaatatgatacgtctggaagaattattagtgggcctgcaccacttaatcttcctgttcctgattactatttttctcaaaaagacgttattgttataggagtgaagggaactgatgttgcataaatataaggtaagaggtattagttaatgtctgaacatgacaatataaaaaaaacggaagggcgtggcattagggcttggatagaatatagaatgccgattggtgcttttttaaaagagttagcttcatatcaggtacctaagaacctgaattatgcttggaattttggttctcttgctggtattgcactaatgctacagattatcacagggatatttttagcaatgcattacacaccacatgttgcacatgcatttagtagtgtagagaggataatgcgtgatgttaattatggttggttaataagatatactcatgctgtaggtgcttcattcttttttatagttgtgtatatacatatattacgtggtttatattatggttcttataaaagtcctagagaattagtttggtttgttggtatttttatcttttttgcaatgatggctacagcatttatgggatatgtattaccatgggggcaaatgagtttttggggtgcaactgtaattactaacttgttttctgttatacctttaattggtcaggatgtagtacaatggctatggggtggtttttctgttgataatcctacgttgaatagattttttgcgttacattatttgttaccttttattattgtgatgcttgcttcattacatgttatagcattgcacaggtttggatcaggtaatccgagtggaatagaagtaaaatctagtaaagacactattccaatttatccttactttattgttaaagattgtataacatttggtatattttttattcttttatttttgtttgtattttatattccaaattacttagggcatccagataattatattgaagctgatcctatggtgacacctgctcatatagttcctgaatggtactttttgcctttttatgctatgttgcgttctattcctaataaattattaggggtagttactatgattggctctatagcagtgtggtttttgttacctgtattagataaatgtaaggtcaagagtggtagtcatcgtccgatttttagaatcttttatctgttctttgtagtgaatttttgttttttagcttggcttggtggacaagaagtaagagaaccatttgtaacacttagtagattatctacattatattatttctcatatttttttattgtgttgcctatattgtctaagtatgaaaagccagttgtgcttccaaaaacgataagtgatgcagtgccggagatgaaataatgatattaatgcggtttcttcttatagtttattttgtttgtgtgtcatttgtatgtgctgcagaagaatttaaacatctatctcctaagaaaattaattggaaattcgatggtatattaggttcatttgataaacagtctatacagcgtggttatcaggtgtatagagaagtatgttcatcttgtcattctatgaaaagaatagcatttcgtaatttacgtgatgtaggattttctgaagaagaagtaaaagctattgcagcatcatatcaggttttagatggaccaaatgatattggtgaaatgtttgaacgtccaggaattaaatcagattactttattcctccttttcctaataaagaagctgctatggctgctaataaaggtgcatttccacctgatttgtctttgataattaaagcgagacataatggtgctaattatttatattctttattaactggctatgaaagtcatgatcctgatgaaagtggattatatactaatccttattttactactggaaaaatgtctatggctcctccactgtctgatggtttggtacaatacacagatggtacagattctaaagtggagaatatggcttatgatgtagttaattttttacagtgggcagctgagcctgagatggaaacccgtaaaaaattaggaatcaaggttattagtttcttattagtgttgacaatttttgtaatactcgcaaataaaagattatggaaagatctttataagaaataaatgtacttttataacatttttctaatgaagtgttttttttgctaatgttctgatcttataatgattgatttagacagttacatgttaattatgtagatgataaatcttgttacttaaattaagtgcttaatttcaatgtaataaaagaccttattttcagcttgttaatgtatgatttttttatctagcaaattagggtgcatactagaataaattcctagtattataaggtatattttattaatttcttaatatttaaaatatgttatacagtatactatattatgttaaaacataataaattgtattttttaggataattagagcaattttatcattgataatactttttagtaagtatatatatcatatatcataatattattgctgttttagcaatagtgtaattagtgtagtgtgtaactaattgggtgtgtttatgaaaaatctttttgtgatttctgcttttacttctctgttaatgatgtcttcctataatgctttttctgatgaaatattagatggtatttttggaagtaataataaatttataaataatactaagaattcattttcaggaattaataataaggcgttggtaaaaggtggacgtattaaatttgctggtgatatgatatcttatacttggtattcaagtgatgatactaggaattcgaataaatttagtagggttagtaagcgttttgatatagatacgggagggaatattaataatgttggtgctaagcatgatggtatgtttagtattgaaattgattcaaatccggataaacatggaattgtatatggagcatattctcaaataaatatcccacatgtcgcaggaaaaagttttggtaataatgctgcatttaatagaggatcaaaaatatttgctaaaactccttatggtaacttttcagttggatatcaggaaggtgtagagtccatgatgaaattaaatgcttttagtatagttgctggtgatgattctaatatatggacaaagcatttaaggaatattctgcatgaaaaaaaagatggtcaaagtggttattcagtatattatttcaattttaactctgggttatatagtgaaagtttatttcgtaatagtgacaatattgtttttgatgacatagactattatttaggaactggtattatttctaggagttttattaataatttgccatttaggttatcttatcaatcacagaattttatgggattaaggtttggagtaagttactctccttttgggtatgatcagagattgtttgaattacaaaaagatcgaaacagtgatactttaattttggttgggccaaggtatagacatattgttagtggaggtatttcttatacttataatattaaaaatttaaaatttagtgcttccgtgataggtgaatatggtgatgaagagcatgattataaagcgcactataatagatattataggcataatacattaaaggcagtatccattggttggaatgttggttacgataaaatagaattagcagggtcttatggaaaattgaatagtgctggaattccttatgataagtgtgttatacatggagttccttatgagtatgtatataggagtgttattcactggctgtatttgaaagacatggattactattgggatataggtattgcttataagtatgcacctttaagtctaagtgttatttactttatgagtaatagggttggtaatgaattaagtgatgtaaatgtaggcattgaatatgatattttaaaatatagcggttttaagagtagtttgtttgctaattacaattattatacttttcgccaatttagtgacacttataggattcatgtgaatggtaagggcagtatattgttagtgggtgcaaagttaagtttttaaattttcattattttagaaagatgttgttatcatgtaaaactatagtttttgtttaatacttttattagtaatcacagtgtagttatatgtaataagcagtactaagagatataatatattgttttgattagttatatattttgaaatgtctagtatgttattgaaagtatttgcagtttctttagatcatacataatgtaaatctcagggctcatagtatattttgatatttctaataatagtgtagtgattttatattctgtttttttacctattaatttattgttgttttttacgtattatggtattgccatgtagtagagattctgttctttactacttcttttacttcatatgctaagtgtgtccaatattttataattttgtttttaatggatataattattttttttaacattatttgtcattatttatgataatgcctccagtattaactaatattctagtaaaaattgtataaagtactttacttactattatttggtgattaatatctaacttacttaatactagatggttatgttatgaaatttactttagtagcatctgctttagcttctttttttgtgttatatggaaatattttattttcagcagatatgttaggtgatgttggtatttttaatcctaatgatggaaataacaaacaatctaatggtattaatggaaaaaatctttttaagacaaaggattcaggaaatggcgagtatgatcgttcatcaaaagtaggtcgtgctttagtaagtgggcaagctatatcttatatgtgggcttcatcagatgaaaagaaaagtttctatgatatatctggtagtgcagatgattggggtatgaattgtgatgctatattacgtttaggggctgaaataaaatcaaatgattctggtgttaaatatggtgcagattttcagatagctatacctcatgttcaagggaaaaattttgaaaaaaaagctgctttaaatagaggatctagaatatttgcttctactccatatggtgatttttcaatggggtatcaagaaggagtagaatctatgatgaagatagattcttctaatatagtggctggagatgaaagtagcagttggacacagcatctgagaggtgtattatctgaaaaaaagaatgctttagggtatacaatgtatccatttcttttttctgctggattatatagtgaaaacgtatttcggaataatgataatatgacatctactgtggatggtagtaaggattttattaataatttaccttttaggatatcctatcaatctcctaattttatgggattgaggtttggttttagttattctcctttaggttataaatttcagcattttggtagaacacttgatatatattctgttaaggcaaacaaagtggttaatcaacttcctacttttgaagtaaagttaccatctgctactgtcaatttaagtgaattagttaaaaagttgggaacagctaaattagatgctgaattagagttgtctaagcagcaagaactggataaaaatgctcttcatattaagtttaaggacaaagaagaaggatatctaccatgtaaaggtaaaattgagttacttggtgtgccaggagcaggagtgtcttctcatgatcctattgaatttggtattgaagtagatagtatagaagaagttaagatccctatatctcagattgagttaaaaaacttgacaattacattaccagatttagaaaagtttgacagtaacttaccagttattcaaaaaggagatactcaagtcactaaaaaaggggaaagggaatctatagtaacaaaacgttccaaaaataaatcagatcaggtgttttttggtgcaaaatatgaacatatattaagtggtagtatagcttatagctatgatttaagtaatggctttaagtttagtacttctcttgtaggtgagtatgctcatcctaggctacattttaatacacaaaattatgatatttatccggaaaactataatttacaaggtatatctattggttctctattgagttatagtaatgttagctttgctattgcttatgggtatttggggcattctggttttgcaaagcactacattctgcataaaaagacagcacgaaatggggaatctaatgctatatatacaatgtgtgaaaggtctaacacttattattgggatatagcttttgggtatcaatataaatcttctaatattagtgttacatattttaagagtaataggagtagtaatatattacaggatattagtttaggtgttgagtatcatttattaaaagagcaaagtaaaatgaagtgcaaattatttggaaattatcaccactataaattttcggaaattactattgctgtagataatgttcgttatgacgatggttatgataatagtgcaaaaccaggtatttctcctgtcataggtacaggacttgataaaagtaatgttatcagaaatgcaagtaatggatcaggtaacatatttttagtaggtgctaaattagagttttaaatatttgtattattactattgattatttgctgagaaaggttatgttgtatgtttgaatttctgtaatgtgttttttgagtatagcgtgtgtatgtttgggtagtgctatacttttatattttaataccttatgtgtttatgtcttttatagctacataataacgttactgtattgatagtgttcatctaagaatatagtttagttcttttgataaagctaggtttattatcttttatttaaatttttttctgatatcctttcaattttattatattgcttgtattgttattttaattattttttagatttgtcttgatttttagtaaaaaaattatatacatcattatatttttatattatttattaacaatataaagattatttcttgacattgtatattatacttgattaagtattgttaatatatttatttattaaattaatttcggtaatctttatgaaaaagttttcgtttgctactgcttttgtttctttcttgcttttgtataatgttgatgctttttcagtagataatatagataaaaatcatgaaaatcagaaaaaactagtaaaccttataaaaaataatgaatatgtaaaacaagcaagtttgcatccatcaattaagagttatcatagaattgatcttgggggaaaagtattgtcttatgcttggtttactaataattcagaaaaaatgcaagatcatggagtaaaattagatggtgttttaaatataaaatctataaataataattctgatcttggaattttctatggtggtaattttcaattggctatacctgctatgaaaagtgagaattttattccttcgatgaaagcatataatagaggagcacaattatttgttgaatctggttatgggaatttatcatttggatatcaagaaggtgttgagtctataatgaaaatagatgcttctagtataggagctggagataatagtattgcttggttacaatacacaaacttatcaaaccttgatggaaaagtacagtatcaagtatttcctggattatatagtgaaagtgtgtttaacaggagtaataataatgttatttctattaaagataaggattttgttaataatttgccattcaggatatcttatcaatctccgaattttatgggtgtaaaatttggtattagttattctccaacaggttatgatagtaacttattcgaaagtgtgagttcttataatattaaaaaattaacactacctcctgtaataagtgcagatacaacttctgagatacaagcaaatcctaatgataaagataatattttatataatgcattaggtaaagaaaaagttcaagatgtcactatagaaggtatagttccgtctaaaatagagtttttgcaagcacgttatgaaaatattgtaagtgctggattatcgtataatcattcttttaatgatattgattttcaagcatctgttgttggagaatatggatctactgatattgataagttaaagtcatactcaaagtatccatctgctgaaaatttagcagcttttgctattggtacatctgttacttatcgtgatgttatagttgcaggttcttatggatatttgggaaaatcaggttatattaatacgatttattctgctactgaagctcctttaaaaatgttttctcctgataatcagtatacttattattggaacattggtgcaaaatatgtgtacagtaacgcttcaattagtacatcttattttagaagtaataaagttaatactcacttctatgactttagtttaggtattgattataatttatctctaagtagtagtcataagggacaatacaaagtttttggaaattatcattattttaatatagataataagaattttaaagtttcacgtgatggtagtgtgctattactaggtgttaagtatgaattctaagatttaattgtatttttgtgatagaattactataacttacttgtatgtagtatgtataaattactatctgattaatacatactactatgccttttgtttaaaaatagaattagttttgtttctatttgatatgtaattttaagagattttctatttaattctttctgtatattttattagtgtaatattttttattgtatgttttttatctagtatattgtgtacgcgaaaaatattttttagtgtttaaatgttttaagatgtaaaaagattggtagaaaaatatatgtcatattataaaggagttagagaagtagtattggatactgaaacaacaggattggatccagatggaggagatagagtaatagaaataggatgtgtagagttaatagatcgtgtttttactggcaaagtatttcatgaatatattaaccctgagcgtgatataccttattatgcaacaaaaattcatggcattactattgatatgctaaaagataaacctaagttttcagaaatagccgataagttcttggaatttattgataatggcatcttagttattcataatgctggatttgatattaaatttattaagatggaacttgataggattaataaaagttataactctgactttcaagttgttgatactcttgttttagctaggaaaaagtttcctggagtttcatctactttagatgctttatgtagaagatttaatatttctctacaggatagaaagtttcatggggcattattagatgcaacgttgctaggaaaggtatatgtacaattgatggggggtttacaaagactttggagttttcttataataataacgtttcaagtgctagtaatatagataaaagatgtgaaaatctttgtatagaaccacgaatttatgaagtaagtgaggaagaaataaaaaaacataagatgttgttagaaaaaataaaaaatcctatttggaataacatattttatacaaaaaccgagtaatatactttatgctttagtttattgtgatgatataaagtatcgttttcaaaaatatactgttttgattaaaagatttttagttaaactgctaagtgtatacatagataatgtaggtattgtttgtatgaaaacaaataaggtctttattaattcatatttggtgttaagtataatgttttagtatcttttgagtattaatatattttattacataaaatgattaaatcctttatttgttggtgtaataatatttctgttattatcatatagtgtgacgcaattgcctagtgttatctctcctatcttacttatttttactttatttttacaagatatgtcttgtattaggtgagagaatttgggatttatcgtaaacactaattcataatcgtctcctccagataaaatatagtttatatattgaggtgtattgtttattatttctttggcttcatttgataaaggtattttatctaaatatattgatgcgcctacttgagatgagttgcaaatatgttcaatatcttgtattaatccatcagaaatgtctatacatgaagacgcgattttattaatgctgattcctaaattaattcttggttgaggtatatcatatttattttttagtttgtaatagtttttgttgattattttttgatacacaagtaatccaagtgcagcatctccaatattgccgctaacatagataaagtctccaatttttgctccagatctttttagtatgttaccattacttgttccaaatgcagtaatgcttactataatttcatcttgtttatgagatgttgtatcacctcctaatagttttatacagaatttttcatgttcttctcttaagctatcagtaaaatttttccaccaatcttgggatatgttattaggtagtactaatcctaagcagtagccgtaaggtatagctcccattgctgcaatatctgataagtttgatctaagagcttttttagctaatatatttggattgcactgttttaaaaaatgtacaccttctataagtatatcttttgttactaataatttattttgtgtacaatttatagtagcagcatcatctcctattaatgaatcatcatctaatttatatatgtaatttttaatatattcgaattcttgcatattattctctagctatatgtttttttaaataaatatataatttgttataacatagttgtagtattaatatttaatgttttagttttgaagagatgaaatttatattttaatttttagtaattcagtaattatttattaaaaggcaatgaaaatatgttaaaagaaaaaataaaatgtcttttgaaatgtatatattatgcaatggttgatatgatcagacatgatgggatagaacatgcaggttatttgtcatttattatattattatcaatctttccttttttagtattttttatggcattagtgtcgaacgtagctcagttattaaaccactatgatattagtattaatgataaattgattatattaatcaatgataatatccctcatgaagttatttcaggacttatgccacggattcaagaaataatttcaggacctcctcatagcttattaacattagcagttatagggacaatatggactgcttcatctgctgtagaaggaataaggactatattaaataaagcatgtagagtttctagtccaccttcttatatttttcgtagattgttaagtatttttcaatttcttgtgatcactttgacaataattattgctatggtatgtataattttacttcctgtgatttatgaaatgttaaataaggatttaggatatttaaaatatactgtgagtgaattggtattgtttatatctattactttattgtattttattgtaccaaatattaaacaaagtttaatggatgtaataccaggtgcaatattagttactttattatggacatgttcatcctttgtttttacttggtatataaaaacttttcaccaattgaatataatatatgggagtttagccagcattatagcatcattgttgtttttctatattttaagtatattttttatatatggagctgaactcaactacagattaaaaaacatgtttatttaacattgaattatttaggaaaagaatttgtgtgtacgacactatataaatataatgtcgtactagaaaaatatatgctataagatacttgatgtaagttaagtacatgtttttctggttttttcatagagaagttgcgtatagagtaatactattctatacttcttgttgtgcactaggaattccttgcatagtagattgtctaacaacagaagatggtggactattattatcttggccatctagttctgatgtatttcttaacctgtgttgatcatcatcttcagaagtattttgttgtgatgtgtttcttaacctgtgttgatcatcttcagaagtattttgttgtgatgtgcttcttaacctatgttgatcatcttcagaagtattttgttgtgatgtgtttcttgatgtttcttgtgttaaaacgaatggttgtgataatctatttgctactgctgcgcttataagtgataggctacctgctgtaaaagttagaacaaatgcaagaaaaagacccattgatgtttgaggagtaccaggtatttttatattaaatgcaaggtttaatccagaatatattgtgcaaaatgcagagaatgtcattactaaagcagaaactacggttgctacattgagaagtgcattggtagcagaatgttttttattaccgttatgtatcatggttattaaccttataaattaattatttaatttaatattaaatatatatttaatataaatcaagaaaatatattaatattttaaaaagatatataaatatactactaatattttatatatttttagttgatagcttcatatttttatatgtttttgttgagtgtaagataaagactctgcaatgtgatcatatgatatgagttcttgtaaagataagtcagctattgttctagcaactttaagaatttttgtatattgcctagcagatatgttttgtttttttaatacatgtttaagaagttgtattccagatttatctggagttaaaaattttgttataatatcttctgatactatcatatcgttaaaaaacttaccataacgatttttttgaaatttttttgcaagaataatacgttcttttattgtttttgagctttctacttttttatgattatcatatgatagcatattgatatatggtacttctatgtgtatatctattctgtcatttaatggaccagaaattttactttgatattcaatagcacacttaggagtcttagaacaagattttgatagatcaccaaaatagccacatctgcatggattcattgctgcaattaattggaaatttgctggatattttatatgagtgtttactctggatataagaatctctttattttctaatggttgtcttaaggagtctaatactgatcttgaaaattctggtagttcatctaaaaataatataccttggtgagctaatgtaatttctcctggtttgatattttttccacctcctaccatagctgctattgatagtgaactgtgaggatcacggaaaggacgtatggttgatattgatttgttagattttttgataatacttgttatgctatttatttctattatctcttcataagttaaatctggtaatattcctggtaatctttttgctaacattgattttccagtacctggaggaccaaccattaatatattatgaccgccagctgcagcaatttccaaagctctttttgctatcaattgtccttttatgtctttcatatctagatattctggattttctattgaaagtttatcatttgaaacaggtataggttcattgttattgaagtaattaattagtgatataagatgtttaggagataatattgcaatgtctttgataaatgatgcttctgctccattgttatatgggcatattataccagttttttgtttataagcacttatagcagcgggtaatattccagaaactgaagttattgagccatctaatgacagctctcctagtataatgtatggtaagtcgttgatttttggtattatcccaataatcattagtaagcctatagcaataggtaagtcataatgacttccttctttaaataaatctgcaggggataaatttacagtaattctttgtgtgggtaacgatatattgattgagtttagagcagctctaatacgttcacgagattcagcaactgccttatctggcaacccaacaatattaaaagcaggtatgccttttgcaacgtgtatttgtacatcaacatttattgtgtgtattccgtaaaagcctatactcttaattcgtgccatcataaggtgtttaattaatgtgtgaatataaggtcggcattactagtttcttaattgttcattacaactttatatatcgtatttattattgtgtttgtaaagtaatttcttaatattttaagaaattttataaatatttattgattagtataatgttgtattatgattcaattgttttaatatcttgtgaatcttttttaaatcctagtcctactaaatacatttctgatgagtcttttctacttgcttttggtttaaaatactttactgattgaaaataagttttcattgattgatagaattctttttcatattctccttgtaaaattttagtgatgaaaactccgttttcacgtgtaaatcttactacaatatcaagagatatttcgcataaattaattatatttgcatgatcaacttgtttattcccacaagcctttggtgccatatcagataatattacatcaaattttttattatgaaatttatcacttaagagttctatatcattaataatgtcacattgaataaatattacattgggaattgcatccatattttgtatatcaacagcaaatactgggttattattgttgtgtgataccctttgtgctgcaaactgagaccaccctccaggggatgatccaagatctaatacatactgtccttttttaaagatagaaaacttgctatccatttctatcaacttgaacgtagccctagatctataaccttgtttttttgctaatgaaacataggggtcatttaattgcctgtgcagccaccgtgtggaagaaattttacgccctttagcagtttttacgatagtagatatatgtttacatttgttacgttaaagtaaaatgataaattatttttgtctggtgacaagaattattttattgatataatgtatattcttgataccatatctatatctattacggagcgtggcgcagcctggtagcgcacttggtttgggaccaagtggtcgggagttcaaatctctccgctccgaccattgccatctttaaagcctatagaatgctgctgtttagtatgttgtttatatatagagcaggttgataagttgcttaatggcctataaacttaactgcaattattattgcttaatattgttaagtgtgtaatgcatgtaatgctgctttgataatattaatggaaatcgtggtcatactgacttggttgatgtgtagtgggagtagggctaggcgaacgatcatgatgatattcaggttcttgttgtagttcgtgatttacattattgagtccattgccggtagcctcagcaacctcttggttagcatgtgggtaatcatcgtgagcgtatggatcatcagggtgtgctgcttgtataccttctccatcattttccccactggcagctgctgcatcttcacctcctccttcgccagatgcatctcctgattgtgagtctggtaataattttggcaatccaaaaatgttttttgtcatttctgatccaaacactactgtagttggtaagtttgctcctaaacatgtggttgaggcaatcacatttccagttgcactgtcaagaaaacatggtacatttttgtaaaaccatgcaagaaatacaaaaacggaaaatactgtttcttcatcttctggtgctcctccactgccggtattctgttgatgcaggtaagattgcaatgcagacacatttattccgccactttcatttccttccatagactaattactaagtgaaaaatgataatctatattatattgtataattgtaaatatatttttaatatgtgtattatttgagtttgataaaaataaattattgtgtaatgtaaaataggatttactgcaagttggtagtgttttatataaaaatcagtggcattaatagaagatatttttagttggttggcgtaagaaaaagttaatctcgtagatctataagttttattatttcttctctatattttattaaaattgtgtttttttctgtcagaaagtgttttttgaaaaagtatcctaatacatttaagcttaatttaaaatctgttttagaatatttgtattcataattattatacacatcatataataattgaggtaggggtaataaacttttgctatatggtaatccaacggtttttgagactgcttttccagtttttggagaaataaatgttaagttctcatttgtattatttacagcacatcgtgatagatctaacccaaatcctaattctgataatagagttaattctaatctaaggtatttaattttccaattaatatcctgaaattgtattgaattaataaaaatatctaggcaattataaataatgtaattttcttcattctctggtaatacttgatctaatataacagtagaaaaagctatacacattgttttaagattatcttgtatatagtggtatagagtggatttaattaattcatacttaaaacaacctagattacttattagtcttgagctccatgttacattaacataatctcctatttgtaacctgtgagttgcttttttggaatactttgctaatcctttttttaaaccatgtttttgagtaaatatagaaattataatttgatcatcaccgtattttcttattgcaattactattccttgatcctgccacctcacattaaagctcgttttatagtagttgatgtactatcatacatatgtaagtaaaattggggaatatataatttattacttgtgttattatatttaactactgctggataattatgtgacttaatatactttagttaagtattaattaatgatgtccgggaattatactataattagcataaaatcatttataatttaaatttttgtttattaataatttatgatgtgaaatttaattctgtatggtcaacaagttatttagtaggtacctaatattgtgagctaataaatattatattgcttacttttaatattggtggaaagctgtataatgtagtggaagttatagtggaaattataagagattactatcgatgaatttaattaatactgttaaaaattgtatagtggaaaagttacatatattaagtgataagaaattaatagtgctggatgatgttatattaagtaagttaatagttgattatcctaataatcataatcatggggatttgtatactaatgcagctttaattttaagtagtcatataaaaaaaagtccactagagatagcagaaattttactatctgaattttctaatattaaggaaatatctagcattaatgttgtgaagccaggttttattaattttagtatttctctttatgtatggtatgaagtagtagcttctattaatatgttaaaagagggttttgctaatgttaatataggaaatggacagaaagttaatgtagaatttgtttctgcgaatcctactggaccaatgcatattggacatgctcgtggtgctatatttggtgatgtattagcgaatttattggaaaaagtaggatatcaagttgttagggaatattatattaatgatgctggtacacaaatagacgtgttagttgaatctgtatatttaagatataaagaagctacaggtcaagatattgtaataggcagtgggttgtacccaggattatatttacgagagataggaaagcttctatatgaaaaatatgggacagatttattagagatgagttttgtccgtaagatgaagattatacgtgatgtatctcttgaatatcttatgaatcttattaaagaagatcttgcattgttgggaattgagcatgatgtttttacgtcagaggctgagttattaaaaaataatattgtagaaaagtgtgtgaaacttttagaagataagcaattaatatattatggagtgttagagcaaccaaaagggacagaaatgcaaaattggaagcctagaacacaaatgttgtttaaatctactgatttcggagatgatgtagatagagctttacagaaagttgatggtagttggacttattttgcaaacgatatagcttatcattttgataagatatcacgtggttttcaacatatgattttagagttgggttctgaccatattggttatgtaaaaagattaaaagctgcagtgaaggcattaagtaataataatgctactgtagatataaaattgcacaatactgttaattttcttgatgatggagtgcaagtaaagatgtcgaaaagatctggtgaatttctaactataagagatgttatagaaaaagttggtaaagatgtagtcagatttatgatgttaactcgtaagagtgatgtagttttggattttgattttgctaaagttgttgaacaatctaaaaataatccaatattttatgtacaatatgctcatgctcgtgtttgttcattaatgcgtaatgctccaaatattttaggaatagaggatacggatttttctgtgttatcttcaaaggaagaaatactgttaattaagttacttgcaaaatggccaaatgtagttgagatgtctgcaaaaactgcagagccacatcgcataactttttatttaatagaagttgctgaagcttttcatgtgttatggggatatggaaataagaatgcaaatagacgttttattatagataatgatgttaatcttacatctgcaaggatatatttggctaaatctgttgcgtatattatcagtagtgggttaaaaatattttccatagttcctttagaggaaatgcattaacagttgtagtatatgtttttttaaagatgtgttttagataatgtaattataatagaaataatatacgtagtattagatacagtgttcttccaatagtcaatgagactgttaatcaaactgaagtgtttgatttttttaaaaacacagatacatctttatcctttattgtagttttacaatactctgtgatatttttaacatctgtaatctcttcacatgcaataagtgatatagataaagtttgttgcgctatatattgagaccatgttttaatagagtcttgtactattttatcttttgtatatatcataacatctattttatcagagatattaaatttattatcttttctagagtgttgtattactcttactatatcccttgctatgccttccattatcaaatcatcagaaagttcatgatctaataacactacaccaagtaaattttggtctaagttaatagtgcatgcaaaatcattatgcactttaagagttaatgtatattcattattatttattatataatgttctgcttcttttgtaccaagaagtaactgattattttctaatatttcccattgattattttttaataaaaatattaaacgtttaattttatcaggtatcctttttccaagttctggaaagtttaattttagttggaacgatgctatatcagatatatcagatttaaatgatatactttttacatttatttcttccaataaaatattttggtattctataggtagattgagtaattctggacaattatagctatatataactattttattaagaggttgtctgaccctaatattatgaatattcctgatagatagcacataattacatatgcttattgttaatttcataaattgagtattttgttgatctttatcacttaacatgaagttattcatatttggtagtgatgataaatgtacagattcttctttttgaaagtttaatttttgccaaattgcttcagtaataataggtaaaaatggagcagaaacttttatcatgaaatatatgacggtatataatatattatacgcatctattttgtcttgattgatttctgatgaccagaatctacttctacatcttctaatataccagttatttaatatttcaaaaaactgagtaatattgttgcatgctagttttatattatacccaaagttattagagcatttgtctagctcttccatagcattaaatatagactttatagtactgatgcactcgtatattatgtatctgtccattatgttgtttattccgttgagatctgtaataatttctgcttttattttgtctatatttgcataaatagtaaaaaaattgtagctgttccatactggttttatgacattacgtagtacatctcgtatcattgttccttctttatctagtaatagatctccaccatatagtactgtgtgtgataacattaggaatcgcatagcatcagaaccatattgcttgaacatttgcatgggatcagcatagttgttaagtcttttggataatttttgtccttgagtatctaacactacaccgtgacatatgcaatttataaatggtggcttatcaaataatgctgtggataatatgaataatgtataaaaccatcccctagtttgagcaatatattcagtaataaaatctgctgggaagtagttttcaaaaaattctttattttcaaatggataatgaagttgtgcataaggcattgagccagattcaaaccaacaatcaaatacatcattaacacgtctcatcattgattttccagttggatcatctgggttaggacgtactagattatcaatatatgggcggtgtagatcatttatagatgatatgtcaaaatcttcttctaatgctctgacattatcgaatattttttttactgatccatatacatcgattcttggataattcgggttatctgatttccatactggcaaaggagttccccaaaatctgttacgtgatattgcccaatctttagcgttttctagccacttaccaaattgtccactgcgtatataattaggaatccagtttacagtcttattaagttctatcatcttatcttttatttttgtgactttaacgtaccaagatgacattgctctatatattaatggagtatctgtgcgccaacaatgtggataattgtgtaaatattgatctgtcttaaagtaaagatttttctgttttaatatactgataatttcatcatttgtatcaaatacatgcatgtttgcaaagtctgaaatcttattagtaaattttgctccatcgtctatagggcaaatagttgatagtaaactagatgtatctccatcaatgtttggaataccttgcttttgacataatataaagtcatcttctccaaatcctggagcaatatgtactattccagttccttctccttctactacaaaatctgctgttagaactttaaatgcatttttaatatctgcgaagtattcaaatagaggtttataatgtaagttttctaaattaatagataaaatatctttattatataactgatattctattttattttttttacaatgttcttcgaaaatttttaaatatcctttagcaaaaataaacatttcttgattaataatagctccgcagtatttaatgcttgcgcttatagctagagcaagattgcaaggtaaagtccatggggtagtagtccagactagcattttatattttttgacattttctattgtaggaaacttgggattttctaataattcaaatgctacagtaacagttttgcttgttttttgtctgtatgcattgtctattctagtttcaaagtttgaaagaggtgtttgacatgcccaactgtatggtacaattttgacagattcgtatattaatcccttgttccacaattcatgaaatgaccacattattgattccataaaagatggattcatagttttataatcattttcaaaatctacccaccgtgcttgcctatctacatattgctgccattcttttgaaaatttcattacagaattgcgacaatgattattaaatttttctataccaaatttttcaattgctaactttcctgatattcccagttctttttctgataacatttcagcaggtaacccgtgacaatcccacccaaatcttctgtcaactttaaatcctgccattgttttataacgagctacagtatctttaatgaatccagttagcaaatgcccgtaatgaggtaatccatttgcaaatggtggtccatcgtaaaatataaatcttttgttttcatcacggttatctacagattttttgaaagtatcattttctttccaaaactttaatacctcttcttctattgatgggaaatcaggttctcctgttaattgtgagtaatgttctgtcataatgtttattattgagtatagatattttactatacacatatttattgaagctgcaatcagagttgtattaaaatatgtgaaaattattgactcctattaatatttatagcattgttttaaaaaatttatatggaggaatatatgacagttgaaataggggatgatgcaccacattttaagggtattgatgcttataaaggtgaaaagaatatagtattgtatttttatccaaaagatgatactcctggttgtacaagggaagcaaaagattttcaagatgcgatggatgattttgctgatttaaatactgttgtaattggtgtatctaaggatagtgaaaaatctcatgaaaatttcaagaagaaacataatatattatttgaattaatatctgatgaaagttctgagttatcaaagcaatatggtacttgggtagaaaagaatatgtttggaaaatcttatatgggtatagatcgttctacatttttaatagataaaaatggaaaaataagaaaaatgtggagaaatgtaaaagttagtggacatgttgataatgttcttgagataataagagagataatgtaaattgcaaactaatgatacaaaaggcaaaaaagctgaatgttaggttgtatgtggattgtactcttagtaaatcttctatagtaatattagataatattgcttctcactatatatgtcatgtaatgcgtgctgcgaaattagatgaggtaaagttatttaatggcagggatggagaatggataggcgaaatatttgaattatctagcaatactaaaattagagtaaatgagttaattagaaggcaatatgtacctaaaagtttaacattgtgtctttctattgtcaaaaatactgcattacagaatgtcattaggcaagcaacagaaatgggagtaacatttatacagcctatttatacacaacatatagcaacaagtaatataaatttatctaaatgcaaaaaatgggctattgaagctgctgaacaatgtggaaggcttgatataccagatatttcttttcctattgattttattgatttaaagcagttgaaaactgatgacaacaatttcgtgatttgtgatgaaacaggtaaaggtcatcctccatcagaggttttaaaaggtaagaataacgttcatattattatagggccagaaggtggtttttcaaatgatgagttaagctttgcctatagtttttgtgatgggttatctttaggtacaacaatactgagagttgatacagcagttgttagtgcattagcttatgtaaaagagtattatggtatgttgtagtagaattatggttgttgaagacattgtcaataagaaagctgagttgcgaaaaaaatatagaaagttaaggaaagaagtaaaaaataaaaaagaagcgtcttattctttattacagaattatgtcaataatgttatcatagaagaaatgtctataatttctggatatatacctatagatggtgaaattgatgtattaccgttaatggattatttaatgcagcaaaaacatatagtagcaattcctgtaatagaagaaaatagtaaaatattattgtttcatcaatggaatacaattaattctgtgattccaaatatattaatagtacctcttattgcatttgataaatgtttaaataggttgggttttggaggagggtactatgataatactatttctaaattaaaaccaaattgtaaagtgataggtgttgcgtatgatatacaattatgtgatatagtacctactgaaagccatgatcaaattttagatatggtgattacagaaaagaaagtttataaaaatatataatatctgattgcaagtaatctggagattttaatacgttgggctttaatttgtgtttttttataagttttttttcatgtttaaattattgttttaatgtacagttcattatggctattaattgagtgacagtatattgaaatgcatagtaaaacgctgtcttttgtgttaaaagtgtaatacaatgttgttgtttaaagaaattatacatgcatactccagttttattgaacgaaatgttagacatattaaatcctcaagatgggaaagtatatgttgatgcaacgtttggggcagggggatatactagagcaattttgaaatctgcaaattgtcaggtttacgctattgatcaagatgaatgtactaatgttttctatgagaaactggttaatgattttccgggcaaggtacatttttgtgttagtaaattcagtaaaataaagcaaatattgcatggagctcaattaaaaaaagttgatggtatagtatttgatataggagtttcttctatgcaattggaagatgctagtcgtggtttttctttttctaaagatggtcctcttgatatgaggatgagtacttctataagtaatgttgatgcatcggtatttgtgaatacggcatttgaagaggagatagctaatgttatatatcagtatggaggtgaaaagtattctcgtaagatagcgaaagcgattgctgaatcaagaaaaaagaaaccaattaaaactacgggtgaacttgcatctatagtaagatctgtaatctcacgtagtaaaaatcatagtattgatcctgcaacaaggacatttcaagcaattagaatatgggttaataaagaattagaagaattagaacaaggcataattgattctgctgatttattaaatccaggtggaaaaataatagtagtgtcttttcattctttggaagatcgaattgtaaaggtaatgtttaaatcattatgtagtggaagtagtgtaatttcaccaataggatttcagttaattaataaaaaagtgataaggccaagttttgaagaaatattgaataatcctaggtctaggtctgcaaagctgagagctatattaaaaatatagtgtgtactttaaatgaaagtttgagatttgttatatattaaatggatcatatatatatggttcggcattggcattttttttatgtatatattgaattaaagtagataaaatagcatatcgattatcttttatcgatgatacgaatatctctttttttgtatactgtgataataattgcttttttttagtaatttcttttttctctagtaaatcgcttttatttaatactatgaactctggtttattaattagctctttattataaagtaataattcttttctaatacattcatatgaatcaataatatcatctagagtgcagtctatgatgtgtagtaatgtagaacatctttcaatatgttttagaaatttgtcacctattccatatcctaaatgtgctccagcaattaatcctggtatatcagctaatactaattctctattgtcaataaaagctactcctaaatgtggttctaaggttgtaaaaggataatcagcaatttttgtttttgagtcagtacatgaagctaaaaaactggattttcctgcattaggcaatcctatgattcctatatctgaaataatttttaattttaatgtgatatatttttcttctcctgcttctccgagggtaaaataccgaggtgctctattagtagatgttttatagttagcattacctgttccacctttacccccttgtgctactataaccttttgattttctgaactaaggtcagcaattaatattccatcttcatcatataattgagtgcctataggaacttttataataatatcttttccagatgatccagatttctttttgccagaacctggatttccattttctgcttttatatgctgtttatatctaaaatatagtaatgtgttaatgtgattgcttgtagcaaaaacaatattgccaccattaccgccattaccgccatctggtcctccgaattcaataaatttttcacgacggaaactactacagccgtttccaccatttcctgcttttaagtagacttttgcttcatcgataaagctcataatgatccatagtatattgctgaaatgcccagtagtttttctatatataatagttcgttatattttgctaggcgttcagatctagataaagaaccagttttaatttgtccgcaatttgttgcgactgctatgtgagaaattgtagtgtcttctgtttcacctgatctgtgtgatattataacgttgtaattgtttttttgagcaagtcttatagcattaaaagtttcagttaatgtaccaatttgatttggttttattagtactgcgtttgccatgttattatcaattccattttgaattaacttacagttagttacgaatagatcatctcctactatttgtattttgttacctaactcttgtgttataagtttccacccgtttatatcttcttctgctattggatcttcaattgatatgatgggatactgtgaaattatttttttgtaatattctactaattcttgagtatttaattcataatctgcaaatttatatttttgatctttgtagaatgtagatgcagcaatatctaaccctaatgaaaaatcttcatacattttatatcctgacttttctacagcatctataatgatttcgaatacctcagtatttattcttatgtttggagcaaatcctccttcatctcctacattagtattgagtttcttatgtttaagaatttgttttaactgaaaaaatacttcagctgacattcttattgcgtcttcaaatttattagctccatttggaataatcataaattcttggaagtctaggttattatctgcatgcattccaccattaataacattgataagaggagtaggaagtacttttgctgtgattcctcctaaatattggtataaaggaatgtttaatgctaatgctgcagcttttgctattgctaatgatattgcaagtgttgaatttgctccaattcttgatttattatctgttccgtctatttcaattaatgcgttatctatcttttcttggtttaaagtgttcatacttataatttgtggagcaacttctgagttgattaaattaattgcttttgttacaccgtatccgttatagaagtttttatcattgtctcgtaattctacagcttcaaattttcctactgaagctcctgaaggtacacaagcttttgcttttatgtcatttgatagtattgtttctacttcgatagtaggataccctctactgtctaaaatttgtctagctaatattttactaattgttatattaaacacaacattaccttttgcttttatgatgttatttaaaaattctacaagatagtaatatcttttatgtgaaatgtaaatttattctcaatgttgacttaatttaaaagagtaacaatgttattgacatattatgttatattgagcagaattactaaaaataataattgatttgaacgttaagagatatattatgtttgctattgttgaaactggtgggaagcaatataaggtaaaagagcaggatgttataaagatagaaaagttaaatgcttctgtaggggaggaagttactttggataaagtgattgcgttggctgatgtgaataacaatattgtttttacacataatgcaattgttacagcatcagttcttgaacaatgtagaaatgataaaataatagtttttaagaaaaaacgtcgtaaaaattatagaagaaagaatggtcatagacaatacatgactgttttacgtgttactaaaattaacaatatggagtaaatatggctacgaaaaagtctggtggtagctccggtaatggccgggactcgagaggtagaaggttaggtgtaaaaaagtttggaagtgaaaaagtaattcctggtaatattataatacgtcaaagagggacaaaatatcaccctggtaagaatgttggtattggaaaagatcatactatcttttctaaaatctcaggttttgtacattttaggaaaggtgtgtataataagacgtttgttgatgtcttagaagctagttctgtttcttaaattatagtagcttttaggggtttgtagctcaggtggttagagcgcacgcctgataagcgtgaggtcggaagttcaactcttcccaggcccacccgtttaatcatgttcttttaatggatgtgttttttacttttaggagttatgtaatattgttagtatagtcttaatgttagcggtgtttgtataggtcgttattaattctgttagttttttggtaatttctaatattgtataaggctttatgttaaaggatagtgataaagtatttactaatcttagtggtcaatattctccgtttttgagatctgcaaaaagtaggggtatttggagtaatattttagaaatattaaacttaggtcctgaacatattattcaagaaataaaaaaatcaggattgcgtggtagaggtggagcaggattttctacaggattgaaatggagcttcatgccaaaaactagaaaagaaggacagccagcatatttaataattaatgcagatgaatcagaacctggtacatgtaaggaccgtgatatattaagatatgaccctcataggcttattgaaggaatattaatagctggttttgcaatgaatgtaactacagcttatatttatattcgtggtgagttttataatgagtatttagtattatctaaagctttagaggaagcttataaagctaagttaatagggaagaatgcatgtaattctgggtatgatttagatatttttattcatagaggtgctggagcatatatttgtggtgaggaaactgctcaacttgaatcattagaaggaagaaaaggtatgccaagattgaagcctccttttccagctgcaatagggttatatggctgtcctactactattaataatgttgaaactattgcaactgttagtgagatcatgaggagaggtagtgattggtttgcatctctcggaagagaaaataatactggtactaagattttttgtatatcaggtcatgtgaataacccatgtaatgtagaagaggaattagggattcccatgaaggagcttatagaaaaatatgcaggaggtgttcgtggaggatgggataatttattagcagtaatacctggtggttcatcagtaccaatgcttccaaagtctatttgtgacactgtaaatatggattttgattctttaagagctgtacaatcagggttaggtactgcaggactaatagttatggacaaatcaacagatctaatagcagctatagaaagattatcacatttttatatgcatgaatcttgtggacaatgtacaccatgtagagaaggtactggttggatgtggagaatcatgaagaaaatggtaaaaggtgatgctacatctgaaagcattgatttattattgaatattacacatcaagtagaagggcatactatatgtgctcttggtgatgctgcagcttggcctatacaaggattaattagacattttagaaatgttattgaagatcggataagggattataataatgataaattaacttaatctctatgtgttatggtttttatttgtatttaaaaatatatctgtttttcatgttaatgtactgttaggggattatatataagtaaatttttaacttttattaacatatcaataatttaattattttttatataatttttaactaaataggtgtaatatatactttaattttattattattaataaagatattaataattttaagtttggagttaatatgcacttaacgttattgttgcttagaaatggtatgcctgttttgttacctgaagcagcatgtaagtatgataagagtctaggcgttgcttatacaatggatcccattatgaatgagcaattagggattcctacatcagatagtccttatagttatctatataggtcaaactttacaaagtttgctgttgtaagtggtgcaaattctgagatgaatgtaatgtttatttttggtaatagtccagtattatcttgtcctgtatttatggtctttacacttccatatggcgttgttcgtgatgtaacaaagaatggtataatgttagataatacattgatcccgttacatggaaaagttagtgaagacttgttaggtctttcaacagaagagcaagtgatcaagttatttaatgagttaaaaagtaatctcaaaataaatgcaagttctgggcagtgtcgtatgcagatgtttaactatgttaatgggaatggtgagttgtttcacacatcatttcataatacagctttggatagagtaaccgtgaatcctgtagatggtagtagacgatatattatgaagatagaatagagatttagttttatagaattatttttaagattgtgatgagtaataaaaagctataattctatttattaagaataaatttttttagtagaacttattaaataatcagcattagcattatagaatatatattagccgatactgttatttaaagtaaattttcttgaattactaaaaagactgtattattgatagtgattaaggtcaatgcataaatatctactccagagcagaattctattttaaaaattataaatgaagacctactttataaagataatacagagtaaacaggatttgagagataaactacagatatagaagataatactattaatactgcaaaaaaatggaacaaaaaataaatcattatatttatattctgttaataattaacaaattcaacaaaagagtataactacatcaaacattcaagtaaactattattatagtcgaaatgcataagtcaataagtattactaataatctataattattgaattatgtaataaaatgaagatgattttttgaaaaataattaattccaataaagtaaaactatcatgtaatgtatccataaactaagatcttaaaataaaaatcttttacaatagtttagtatacttatttatcaattcagaataatacttaccttatattaattgactatcttgtttaacatatttataaaaatctactttaagtattgctttcaacgaacgcgaatatctgataaattattatttaaatcgcataacaatagaaaaaacatgagtacacaatgctttcagaatctcataataaatacattctcattggatactggatctactataatgtgatccaaatgtgtggtgctatattctctatgaaacacttctccgctcatattaaaaaaatcaaacctatatgtacaagaagaattggtcctaaaaggaatttttatccactcccgactattacgaaacaagtttattgtgtgctcttctggtgatatccctggagtagttatttctccacatgttattaatcttccgtcattcaacattaatccaagagaatatatattatgtaaagaaccatgttgagcaacaaaacctaaatataactctttaccttgtggatttttaccatacataaagaaaatgtcgtttgccaaaactgcattagatataaggcaatgttggccaaattttgctttatgtatcaaatgtacataatcaggatgaatattaggaactggagtaattatattgatattctgatcttttggaatgtactcgtctgatgacttatcataaatacattcgttctcaggtattaaagcaagaccattttgtgtcaacaatgatattagtttcatataattttttgatataaatatattaaattttagtatattaatattctactacattataattgacaaaatcaattttccatactaaaattaaagtttttactaaaaagttactactactactttctataaatacatgaagtactatgaataacctattctaatacagttattatcatcaagttgataaatcagcttcaatctcactaaacgttatttcgcaaattgtttcatatcagaagcttaatatcagtataaaatatacaaacaattatacagtatgtactgtaaccattttaaacctagtcacaatagcacatactaaaatttataaccttttttcacaataataccttaaaaaatctttttatttactgatttaataatatcaaatatacgtctgcattttggatcacattatagtagacccagtatccaatgagaatgtatttattatgagattctgaaagcattgtatactcatgttttttctattgttatgcgatttaaataataatttatcagatattcgcgttagttgaaagcaatacttaaagtagatttttataaatatgttaaacaagatagtcaattaatataaggtaagtattattctgagttgataaataagtatactaaactattgtaaaagatttttattttaagatcttagtttatggatacattacatgatagttttactttattggaattaattatttttcaaaaaatcatcttcattttattacataattcaataattatagattattagtaatacttattgacttatgcatttcggctgtaataatagtttacttcaatgtttgatgtagttatactcttttgttgaatttgttaattattaacagaatataaatataatgatttattttttgttccatttttttgcagtattaatagtattatcttctatatctgtagtttatgtctcaaatcctgtttactctgtattattcttaattttaacattttttatatctagtacattatttattttattgggtgcagaattaatagcaatgctagttataatagtatatgttggagctgtagctgtactttttttatttgtagttatgatgttagatataaattattcaagattgaaaagtggctttacgaagtatcttgctatagggttattatgtggaatgatattatttgttaatatagtgtttgttattaagcagtctgcaacaactgaattagtgacgggatctgtttcttatgtaagtaatgttattgctattggtaacttaatatatacaaagtatatgtatgtgtttcatttatctgggatactacttttgatatcaataattgggtctttagtattaactttgcgtactaaaaatggcaatgtatataggcaaagtgtaggtgctcaagttaatagatcatctactgtgaaatatgtgaatgttaaagtacgacaaggagtagattatgaaaattctaactgaagctggtattactttagatcatttccttattttaggtgcgattttatttactattggtgtgtctgggatttttattaatcgcaaaaacatcattactattcttctgtcaatagaattaatgttgttagcaatcaatatcaattttactgctttttcagtataccttgataatattttaggacaagtctttgttatgtttatattaacagttgctgctgcagaatctgcagtgggcttagctattattgtagtatatttcagaaattgtggaaatattaatgttgaaacagctaataagatgaaagagtagaaaattttttaggtgcttattgactaatcataattaattaggacaggttttatggttaaagttgaactattatgtgtttttttgcctttaatgggttctatttttgctagtatgatgaataatagattaatgtctcaattagttgcaacatccttagtagtttgtgcatcattattgtcatggtacttattttttaattttaaagatagttatgttattactttatttccgtggattgaattatataaattaaaagttagttggtcattgtatatagattcattaagtatgattatgctaataatagttaatacagtgtcagcagtagtgcatatttattcaatgggttatatgtctcatgatgtaggtgtatctagattcttatcttatgtgtctctatttacattttttatgttgattttaataacgagtgataattttgctcaactttttttaggttgggaaggtgtaggtttatgttcttatttattgattggtttttggtttgagaaagcttcagctactaaagcagcaatgaaagcttttattatgaataggataggggatttttttttcatattaggaattgtagcagtattttgggtatttggatctttagaatttaataagatatttaacatgcttgattcaatatatgttgaaggtgtagttaatttttttggttatccgataccttatttggatatgatatgtttattgctttttattggatgtatgggtaaatctgcacaaattggtttgcatacatggttacctgatgcaatggaaggtccaactcctgcttcagcgttgattcatgctgcaactatggtaacagcaggggtatttcttgttgccagatgttctccattatttgaattatcagttatggcgcgcaacgttattttgattgttggtgcgtttacctgtttatttgctgcaactgttgctattgtacagagtgatgtaaaaaagataatagcatattctacttgtagtcagttaggatatatgtttattgcatgtggattatcagcatatagtgtagccatatttcatttaatgactcacgctttttttaaagctttattatttttgtgtgcaggtaatataattcatgctacacatgaacaagatatccataaggtgaatgcttcttggcgtcaaataccatttacatatgtgttaacttggatagggtctttagcattggcaggtatttttccatttgctggtttctattcaaaggatcttattattgaaagtagctatcatgttagtaagattgcctttataatatgtaatttggttgcctttttaacagctttttattcttggagattgattatattagttttccataaagtaagatcaacaagtctttcaatacatgagtcaggaaaagtaatgcttgtacctttattgatattagctataggttctatattttctggtatgtggggacaaaatttattactgattaatgatgttgcattttggaaaggtagtataaagatacatgagcatgtagaagtgggattatttgtaaaattattaccattatttttaagtatacttggaatagtgtgtgcttatttaaaatatttttacaattgttttggtaatttttattgtaatcgattattcaaatttctatataataagtggtattttgatgagttatataatcttatctttataatacctgttagatatatagcgagtttcttttctaaagtagttgataaaaaaattattgattattttgggttaggtggtattactaagatagtaaattgttgctcaaagggtagtgttaagatacaaactggttttatttttgattatgcatttattatgctattgggtttgataagtattatcatgtggttaatttataataatataagattttaaagcatatgctatttttgatggttttattaccaatattggggtcatgtttattagcagttagtaattttaaggcaagttcgttatctataagagtaatttctttattatgtgctggaacttcattttttataaatattattgtagctgtaaagtttgattatttatataaaggttttcagtttatacataatctggcaccaggttttgtagtcggtatagatggattatctttgccacttctattattaacaacttttttatttttattatctgttgtttttgctttatataacatgcaatcaaataatttgcgcatatttcttgctttactgctgttattagaaggattgaccgtaggagtgtttgtttcacttgatatagtaatgttctatatattttttgaatctgttttaattccaatgtttttcattataggaatgtggggacatgaggataggatatatgctacgtttaagttgtttttatatactttaagtggttctttattatttttaatagcaatattatatatatatttcttttctggtaaaataagcgatataggacagttgacttatattttatcaaattatttgaaccttaaagcacagaagtgggtatggattgcattttttatttcgtttgcgataaagatacctgttataccttttcacacttggttacctgatgctcatgttcaagcgcctacagtaggatctgttttattggctggtattcttattaaagttggtacatatgcattactacggttttctctacctatgctaccagaagctagtatgtatttttcaaattttgtaatgatattaagcatcataggtgtaatttatgcttcattaatatcttttgttcaaactaatattaagaaattaatagcatattcttcaatagctcatatgggttttgtgacagcagggatattttcttttaatgaatatggaatatcaggagctgtatttcaaatgattagccatgggttagtgtccgcagcattatttatttgtgttggtatactttataatcgtactcatactttagagatagtaagatatagtggattagcaaaaacaatgcctaaattttccattatgtttatatttttttcgatggcttcgattgctttacctgggacttcaggttttataggagaatttttatctatattaggaatttttcattattctaaattattttcaatctttattactattggagttatattaggtgctttatacatgctgtttttatgtaaaagaataatctggagtgtacaaaattgtgatttaattaattgtaatcttaataaaaatgagttatttattttagtgattttagctgcttttatattattatttggattatatccttattatatcttattaaaatgcttaactccattcatagagcagttgtctttaagaaactttgtactttagtagcatttgagattatttattatgtattggaataattttgtttatataataccagaaatttttttagttagttcatctttaatcttcttattattggggattgtgctgaataaaaaagttatacatgttttttcattggttagtttattagttactattggtattgtcataattaatttagatgttgaaccaaagctaatttttgatggacttttaaaatctagtttgtatatttctattgcaaaaattatcattttattttctagcagtagtgttctattcatgatgttagcatctggtagggaatattgttatgaattttcaataatgattttgcttgcggtttttggtttaattactttgatttctgcaaacaatttactttctttttatttgtcatttgaaattcaaagcgtgactttgtatgcattaacatgttttgataaaaatgcaattagatcttctgaatcaggtataaaatattttgttttaagtgcgctctcttcttgtataatgttatatggtatttctatgttgtatggttatacaacacaagttgatttttatgaattatacaatttcttttcttatagtgaatatatacctttaggtgctgttttaggtgtagtactggttttgattagtatgttctttaaattatcagcagccccatttcatatgtgggttcctgatgtttatcaaggtacttcaactgttatgacagcatttttttctatagttccaaaaagtacgtttgtatttttattaattagaatattaaatgaagtattgcctagtttatctaaagactggcaacatatagtgatttgtgtatcaatattatctatatttgtttcagcatttggagcaatgagacaaaataatttaaaaaggttattttcatatgctgctgttgggcatatggggtatatgttaatttcattagcaatgaatactgttgctagtaatatagctacaataatgtatctattgttatatattgttatgaatataggacttttttctattttaatacaatatcgtgatgatgattgtaacctattaaatttgaaaggcttacataataggtctccggtaatagcattttgtatagctgtgattatgctatctatggctggaataccacctctagctggattttatgctaagtatgatgtgttgttaagtttggtagaaaatggttttataaaggttgcaatagcttttgttattgtaagtgttatttcatgctattattatctacgaattattaaggtaatgtattttgattttagtgatacttccaataatatatcattagcagacaggaatttgtctttcattctgttgtttacagtgttaataaattgtatattttttgtatttgttggtgatgttaggcgtttaataggttatttttttacattttaatttttttaatggataataatctgaatattcgatatataatgtaataaatttattgaatattaaagcatgtgaaaacagtttcaatatttggctcgactggtgctattggtcaaatgattattgatataatatttgctgaccttgataagtatcaggtaaaagtattagttgcaaaatcaaatgttcagttattagcatttcaggctaagttaattaatgcagaaagggttgttattgctaatgttgatttatatcaggagttaaaagatttattagttggtactaatattaaagttagtgcaggggattccggaatggttatggctacatctttagatgtggattatgcaatgatggctattgtagggatggcagcgcttataccgatgacttatttaattaattctggtattaaagttattgcattagcaaataaagagagcatagtctgtgggggtacactattgcttagtttagcaaaagaaaaaaatgttaatattgttcctgtagattcagagcataatgctatatatcaaatactttctagtagtaaaaaaaatttagaaaaaattaccttaactgcatctggtggtccattgttatcaatggattatgatcaaataaaaaatgttacagttcaggatacggttaagcatcctatttggaaaatgggaaaaaaaatctctgttgatagtgcaaccatgattaataagtctcttgaaattatagaagcttattattttttttcaataaaagctgagaagttagatataatcatacatcctgagtctataatacatgcaatagtatcttatgtagatggcgcatctattgctttcatgtctgtgccagatatgaagattccaattatgtatacattgtcctggcccgataggtcagctattttatgtaaaaaactaaatttggcatcatgtaatcaattaacatttataaagcctgacgtttataaatttcctggtataaagttagggtttgaagtattaaaaacgtctaatgttcatgctaatagcattattttaaatgctgcaaatgaagttgctgttgatgcttttttaaataagaagataagatttcttgatattgtaagtgtggtatgtgagacgttaaacttagtcaattatggacgcattaattctctatcaagtattcttgattgtgatctggtaagtagaagagtagcaagtagtgctattgataagttatattaatatattaaattatttactatattgtgtaattagtgtattatcctttctacttgattgttgggttaaatgtgtatttttcagttgttatagttagtattgttactgcttaatagtatttgatttttaaaaaattgttaactagtaaaattcgatttcttttaaatagttatatatttgttttgatattgttaaataatgcgtttacttaacatagtgtatttagtataaatatattaaagcaaataaaccatgtattataggtgttagatgtttagacgtaatatcttgaatgtactgttggtattgattttctgttttgttatttcgtgttcaaataagagtagatatcagtttagtaagaaatattctccagtttataatcctgatggtgaagcttttgatagtgatgtggggttttctcgtgcttactcaatttataaagaacgtagaaatgcactggtttcaggtattgatgaaagcagtaagaaagttagtgtaagacgtaaagtaaagccaaaagttcaagttagagatgttgacttgttaaaggaatatggggatcttttaaaagaggaaaactgtgatttaatggtagatggtaatggcgttaatttagttgatgttgcaggtgctaagtttattgatcctatagaaaatgatgatgatgttatagatcacgataatagacatgttgatgtgaaaagttcagtggtcaaaactaaagataagaataagttacaagatgttaaggataacaaacctagtgatgttaagcttccagtaattaaagctgaagataaaaataagttacaagatgttaaggataacaaacctagtgatgttaagcttccggtaattaaagctgaagataagagtaagctgcgagatgttaaggataacaaatctactgatgttaagcttccggtagttaaagctgaagataagaataagttacaagatgttaaggataataaacctagtgatgttaagcttccagtaattaaagctgaagataagagtaagctgcgagatgttaaggataacaaatctactgatgttaagcttccggtagttaaagctgaagataagaataagttacaagatgttaaggataataaacctagtgatgttaagcttccggtagttaaagctgaagataagaataagttacaagatgttaaggataataaacctagtgatgttaagcttccagtaattaaagctgaagataagaataagttacaagatgttaaggataacaaacctagtgatgttaagcttccagtagttaaagctgaagataagagtaagctgcgagatgttaaagataacaaacctagtgatgttaagcttccggtaattaaagctgaagataagagtaagctacaagatgttaaagataacaaacctagtgatgttaagcttccggtaattaaagctgaagataagagtaagctgcgagatgttaaagataacaaacctagtgatgttaagcttccagtagttgagaatatgattattgatacatctaagttaaatgatgatggtgatcataaggctgacaagaaagaaaaagggttacgttcattattaaaatttacaaaaatagaaaatgatagtaagggttctgataataatgtcgcaggtaatattgctaatgatagtgaggagcctacgttctctcaacctaaaagtgatgtagaatctcctaaacaagtatctgagagtgatgaacaaaaaaatagtcataaagctgtacactttctatcattcttaaacgagccaagtgaagatcaaaatgatacgacagaagaactacaaaatacagaagataaaaaagataatttactagaagagaatgttaaaatatctgaaaaggatgatcaacaagtagtaatatctatagaagaggaaaatcagatgttattacaaagtattaagaagatgaaagaatatgatgaagattatagtattacgtattattatgatgatgatggtatggcgtactatgaagactagaatacatttttaggtagatttgttagggttaactgtatataattttgctttgatacaaggttatgtttttgtatgcaatgtgagattgtagatagaattttaaatgaagatgggttgtttaattgtattgcaaataaaaataaaataacctatgaagtgaaagttggtgatgtagtaattggtggcaacaatcctgtagtagtgcagtcaatggcgttaggcggatctggagatgtgtataaagatgcacatgaggttttagagttagcgcaagctggatctgaattggtaagagttgcagttaattcagaacaagctatgaaaaatgttccgtatataagagatgtattggtagatcatggctttagtgctaagatgataataggatgtggacaatatgaaattgctagattggtaaatgagtatcctgattgtgcagctgctttaggaaaaatacgtattaatccaggaaatgttggttttggaaataaacgggataagaattttgaagatattgttgagtttgcaataaaacatgatatccctatcagaataggtgtaaattgggggagtttagataagtatttagcttcaaaattaatgaatgataatgcattacttatcaaccctaagccagattatatagttttgcagaaagcattggtaatttctgctataacaagtgctaaacgtgcagaagaaattggcttatctaaaaataagatagttatatcttgtaaaacaagtaaaatacaagatttaatacctgtttatacagtattgtcaaatgtatgtaattatccattacatttagggttgacagaagcagggtctggtacaaaaggaatggttagcagtgctgcaggaatatcttacttattgttaaatggtataggagatactatacgtgtttccttaactcaacaacctggtgaagcaagaagtattgaagtcaagttatgtcaagaaattttgcaaagtataggtttaagaaatttttctgcgcaggtaacttcatgtccaggttgtaatagaactaatcctaagtattttcaccaattagctaaagatattaatgattatataaagcaacgtatgcctgtgtggagaaatgataatcccggatctgaaaatatgactgtagcagtaatgggttgtatagtcaatggtccaggtgaaagtaaacacgcaaatttaggtattagtcttcctggctatggtgagaggcctgtagctgcagtgtatcagaatggagagaagttgtgtactttagaaggcggtaatatctttgaacaatttgtatcaattatcgaaaattatgttaatgtttattacaaacaatagtaaaaaaggtaatctataattatggaatctacaactggcgaaatgttattttttaagcattttgaagaattgagatatagagtatttttttgttttgcatttttttgtatcatgtttggtgtatgttacttcttttctgaaagaatatataactttttattaattcctttaatagatctagaaggtgctaattctgaattttccctaatatatactgatttaacagaggcattttttgtatatttaaaagttgctactatggctgctttattgggttcttttcctgtttttgcatggcaattttatatgtttttagctccagggttatataaaaaggaaaagttgatattattaccgtatttgatagcgacaccagtgctttttattcttggagctgcaatggtgtattattatatatttcctttagcttggagattttttattgcatttgaaaatagagatgcttcaatgggcgtaccaatagaattcatgccatcagtaagtgaatatttagatttagtattgcagctaatgtttgcatttggagtagcatttcaaattcctatatttttaacattaatgtctaggattggtatagtatctgcaaaaggtttgtcacgaaagcgaagagtagcaattgtagttatttttattcttgctgctatactgacaccacctgatgtgttaagccaaataggattagcaatacctatgttattattgtatgaagcatcaatactagcttgtaaatatattgaacgttctaaatgatgttttgttacttgtagaaatgttttttatgtgtcatggtattgtataatatattaattatagtaagtataaagtaatgagaaagattgctgagatattcttacaaaggaatagagtatcgatatttctgttgatggttatattgatatttggttgttattcttatttttatattcccaaagaaaagaatcctgaaattaaaaaacctattttatctattcatactacattgcaagggatgtcatctgaagatgtagagaaatttttagtgtatcctattgaacaagagataaaatctgtgaagggtattagtagaattacttcgatggctaaaaacggctatgcaaatgtaatattagaatttagtgcaggatttaaccatagagaagctttagaaaatgtaagatcaaaagtggatgtgatacgtgctaaattgcctcaagaagcaacctttcctataataaatgaagagaattttagcttatttccagtgttaagtatagctttagttagtgatttacctaacaggacattgtttaaagttgcaagtgatttgcaatctagattggaaagtttacctaatatagaaagtgttaagattattggaaatagtaaagatattattgagataaatatttctcctggtgttattaatagctataacttgcaaatgcaagatgtgataatggctgtattgaataataatcagtttctgaatattggaaatttggactctacagttggtaaatatacactgcatttgtcaggtattttaaagaatatagaggacattatgaatataccagtaaaaactgatggttattctgttgtaactgtaggtgatattgctactataaagccaatttatcaagataataaggaatttgttcgagtaaataatcagccatgtttagttctagaaatatcaaagcaaactggtaagaatattattgagactatctctcaagtaaaagaacttatgaataatctcaaaaatatattgccaaacaatttatcagttatttatcttcaagatgaatcggaagagatatcgaatgttttaaatgaattacagaattctattttaatttcagttttattagttgtgataattatgatggtatttatgggaactaagactgcattgttagttgccgtatcaatacctgggtctttcttgtttggtattatcattatgtatttattagggtataccttaaatatagtaattttattttctttgattatggctgttggaatgcttgttgatgatgccatagttgttactgagtatgcagatagaaaaatgataggtggtttgaataaaatggaagcttttaagcaagctgcacatgatatgttttggccagttgcatcggctactttaacaaaattagtagtatatattccattgttgttttggcctggcactactggggaatttatgaagtatattcctattgcattaatcacaactttaagtggttcgtggattatggctttgatttttattccagttttaggatctcttattggaatgccatcagtgactgataaaaaaagtgtagcagaaattatagcgataaatactggtgattttgtacatttgggtagatttaccagaggttatagtagaattttaaataatgtacttaatcatcctaaaaaatttgtttgtgtaatagttagcatattgtttttctctacgtttggatattttatggttggtccgggtgtagagttttttccaaatattgaatcagaaagaatgcttatcactataagatcaaataataatttatctgtccatgaaaggaatgacatattgcgagaagttgaacaacggatttctgatataggtgggataaaatttttttatgtaaaagctggtctgtttgagtattcattggatgtcgataatgttattggaaaaattcaggtggaattaaaaaaatgctctatttgtaggaagtctgacaaaatattaaatgagataagaaataagctacaagatgtgaaaggtgttattataaatattgtggaagaaagaatgaaaccagtcactggtaagccaatacgtattgatattagttcacgtaatgtaaataagattaatgatacaacggataagataatatctattatgaataattctttaggatttgaaaatgttacagacaatagatcatctttagaaatagagtggaaaattgatattgataaaaacaaggcaatgagatctggggttgatatttctatacttagcaaatttataaaaatgatagctggaggagtattattaaataggtatcacccagataatattaatgatgaagtagatattattctcagatttcctaaggaatatcgtaatttaaatacgttgagtaatctgtttgttaatactttacatggatatactgctgttagtgattttattattcataaagctcaacgtaaagaaggtggaataaatcatattaatggtataagaacagtaagtattatggctgatttatctcaagggtatttattagaaaagatgatcaattttttaaatcaaaaatttaaagaggaattagattcagaggtattggttgaaataaaaggagaaataaaagatcaagaagaatcacaaaaatttttaattaaagcatttgttataatagtagtacttattatgttggttctaattactgagtttaacagtatttataatacattaattattatgacagctatttttctatcaactacttgtatattttttggattttttatcacaagtcatgttttttctgtagttatgggaggagtaggtattattgtattggctggtgtaatagtaaataataatattctgcttcttgatgccttttatattaatatgaatactatatgtaataaaaaagaagctatagtaagagcagctttatctagagttaggccaatattattgacagttgttactgggattattggattggttcctatgatgttacgtgtaagttttgattttattaatcggcaagttatttataattcaccgtcaagccagctttggtttgaattatcttatactatagctattggtttatgtttagctactgtgattactttattttttactcctgcgttgcttatgatagggaaatataataaaattaacaaatgaacttacgaggtgtatagtaagtttagtgtaaggagaaattacttgacttgaatagtagttataatataaactcctaccgcggttttatctgaatatgtgtcatttttaaataatcaggtgcactaaatcttagttttttgtacataggtttttactaagggtttttatggttaatctacaaaattttgataacttagagttaataagggtggctaaggatattgctgatcagaaaggcttgaatttggatgttataataagagctatagaggaagctatccaactaactagtcgtagtagatatgggaattgtaagattaaagttacagtggataaaaaaactggtgtagtagctacttataggcaagtattagttatcaataataatggtgatattagtgttcctgaaggcaaagaaaatgagatagatttttctgatgtaagcaaatataaattgattactttagcagaagctaaacaaattgataaaaatgttgaagttggtgatataatgcttgagcctctccctgttattgatcttgattatagttctgctaagattgcaaagcaaaagattgctcaagttattatttcagaagagcgtaagaaacagtatgaagattttaaggatcgtgtaggtgatattgtttatggtactgctaagcgtatagaatataataatgttattgtagatctaaatggaaatgaaggttatttatcagcttcaaatttgataaaaggagaggtatttcgtgtgggtgatagagtaaaagctcacatagaagatgtaagaaaggaaaattcaggacctcagatatttctttcaagaatcaataaaggattcatggagcaattattcaagcaggaaatcccagaaatatatgatggaatagttacaattaaggcaatagctagggatccaggttcaaggtcgaaggttgcggttttttcttctgataaaaatattgatccagtaggtgcatgtgttggtgcaagaggtgtaagaattcagggtattatttctgaattacatggagagaagattgatgtgattttatattctccagaacttgctaaatttatagttaatgctatagctcctgcagaagttttaaaagtcattattgatgaagataaggaaaaagtagagttaattattcctgaaaatcaactaagtttagcaattggtaggtatgggcagaatatcagattagcatctgagttggttggttggaaaataaatgtaataggagatgaaactgaatcaagtagaaaagcgaaagaattgagtgcaggttcaaaaatatttgttgaaggattggatgttgaagaaataatagggcaattgttatttactgaggggtttgttagtattgaagatatagatcaagcatctgttagtgatatttctgcaatagatgggttcaatgaggaaattgcagaggaattaaaaagtagagcagctgattatttagtgcgtaaagatgctgaaatgaaacagattttagataatttatctgttgataaggatgttactatgttaccatttttaaggccgagtgatattatagcgttgtcgaaaaatggtatcaacagtcttgaagatattgctggattgtgtacagatgagttttttgatattattcctgatattgcattgactaaggatcaagtagactctgttatattagagtctcgtaagaaaataggatggttataacttttgttttttgggtagttgtctatgaatgagtctaaaagtgttgtagatagtgggttgatgtcaggtaaaattgaacgtacaacactcaagcttagtgataagttaaaactgtcttcaaatatacatcaaggtacaaagttttctttaaagaagtctgtgaccactgtagaagttcgtaaaagtaaaaaaaggaaagatattaataatattgaacaagcttctgtagtattgcaaaatgataatgcttaccaggataatgaaagtaataattccttaactatacaagagcaaatttctcgtatgaatgctctacagaatgctaatatatgtgaaaaaaaggaagatatcaaagaagatacaagtgatgttaatcttcaagtaacagagtcaacatctgttgaaaaaagtgaaagtgatgatgttactcttgaggaagagagtagtaaaaaagttgaagagcaggtagttgaagaggctcatgataatactgatactgtatctttgaatgttgttgaaaatgtacaagaagagagtcaggtagataaccaagttgaaagcagtaatataagtgatatattgcagcctaaaggcattgaagagaaaaaacttaaaaagtatgaaaaagagcatgaagaaaagaaaggaaatcctaagaaaggggtttctaataatatgtatagtaagcatgtaaaattagtaatagaagaggaattagaagataataataagcaggttattcaaacacataaaagtaggaagaatcgttctactagttctgtaaagaataaaattactcgcaaggttcttatacctaagaagattactgtacaggagttagcgagtagtatgtctgaacgagtaaaagatgtacaacatatgttatttcaaatggggagacgtgatattaagccaacagattttttagattcagatcatgcttctgttattgtagaagcttttaatcatacttttaaattagtgaatgatggtaaattagaagaagatttatatgctgatggtaatgataaggaattacttcctagagcaccagttgtaactgttatggggcatgtagaccatggaaaaacttcattacttgatgctatacgcaaatcaaatgttgcagatggggaatttaaaggcattacacaacatataggtgcatatcaaataatgcttgatggcgataagagaattacttttattgatacaccaggtcatgaggcgtttactgctatgagagcatgtggtaccaatgttactgatatagtagtattagttgttgctgctgatgatggtattatgcctcaaactattgaatcaattaatcatgtaaaagcagctaatgtagcgatgatagttgcagttaataaaattgataagcatgatgctaatattgataaaattactaatagtttgcttaatcatggagtagttgcagagagtttaggtggggatgttattgtagttcctgtatctgctaaggaaaggataaatttagatcaattgaagtcaagtatattattaatggcagagttattagagttgaaagctgtttatgatactagagcatctggagtagtaattgaatcaaaagttgatagaaattgtggggtggtagcaactttaatagtacaaaaagggacattaaaagctggtgatattattgttgttggtcataattcatatggtaaagtgcgtaatatgtttaatagtgatggaagaagtgaaaaagttgctattccgtcaatgccagtaaaagtgttagggttaaataatgtacctaactctggaactaattttattgttgtggattctgaaaagcaggcacgtgagttgattagttatagacaagagttatttaatgcagaattagaagcaaatgcaaaaccaaaaatggatgctaatagcatattagcttgtggtgtggttgatgagttaaatgtgattttgaagtgtgatgttatggggtctgttgaagcaatatgttattcaatcagtaaaataactcatgaggatataaagttgaatgttttatataagggtgtagggaacgttacaaagtcagatgtgttattggctgaaacatcgaattctataattttagcttttaatgtcaaaacagatgcttcagtaaaagaattggcaaagcagaagtgtattgaaataaagcattattcagttatatacgatataattgatgatgtaaaaaagatattaagtagtatgttaaaaccattacagcaagaagtgcaagttggtactttatctataagaaaagtgttttcttctggaagtataggaagtgtacttggatgttatgtgacaaatggaatagttaggaaaggtgctttagtaaaattgattcgtaataataatgttattcatgaagggaaaattaaggttttacgtcgttttaaagatgatgtaaaagaagtcgctgctgggtttgaatgtggtattttgttagattattcaaaagaaatatatccagaaagtgatataattcatatattagagatagtagaagaaattagagttattaaatgatttataaatctgaaagttttaggaatttaaaagttgcttcagtattgaatagggcgatatctagagtattaatgcaagatatttgtttgtttaatagtcatataactatatctaaagtagaagtgagtagtgatataagagatgctactgtttttgttataatttctcaagaatgttcagataaagaagcgcttataaaagaattaaatgactcttcttattttattagaaaagcaatattttcttacgtagatcttaggtatatacctagattatattttaagctagattattgttttgataatttggttagagtaaatcaaatactagaatctaagtaatgcattctgctgctgcaggtattaaaagcaatatattagaatatagtaaaaaagaatactattatattcattgttttacttttttttcctattatatttattccttcagtaattatagaaaaagcagactcttaagtagatcttaggtatatgcctagatatgtttttagcgacgagattattgttttaatattttgttagagtaaatcaaatactagaatctaagtaatgcattctgctgctgcaggtattaaaagcaatgtattagaatattaaagaatactattatatttattattttactttttttcttattatatttatcccttcagtaattatagaaaaagcaaacgtaaagtataggtagttgtgtgatactttaatgtgtattccatttagtgttaagagtatgcctaatactaatacaaacataatggctatagttttaatattactatatgtggtaattgcttttatgatgtaatgtgaaaacaaaattgtagatatgatagaaacaacaaatactatttgaataataagaatgttatgtgtaattcctatggcagttagtattgaatctatagagaatattaagtctactattattatttgtagtattacataataaaaatttgattttaagttatgaattttaccatttttcttaaaaatatcgttccatatttcagataagctttgataaattaaaaatattcctccaaataccataaataaattattaggagaaatatcaagttgaaataatgaaataataggattattcatagctagtatagctgatgctccatataatacagcaatacgcattattaatgctaatgataaccctatatattttgctttattacgtagttcaggtaatatttttgtgacagcaagtgagataaaaattatattatctactcctaaaattatttctaatatcaataatgtaaaaaattgagttatataactttccatatctgatgctttataggatgttaatgttgtatatattatatgttatttaatgcatataatattaaaaatgtattgaatattattgatcctgtaatgcttatatttttattttcaacttatttttaattcttaggtggtagagttttttaaattatgaaattggagatgtcagtgttatcaaagaatctagaagctagtttacacaaggcactgtcaattgcatttgattttcatcatgagtatgctactttggaacatcttttattagctttaactgatgatatagatgcaaggcgtgttttttatgcttttcgtgtatcaattgataaactgaaaattacaattataaattttctgagatatgaaatacctactttaattgataagggtatttcagaagttaagcctactgctatttttgaacgcttaatacatagagctattatacatgctcatacttctggtaagagtgaggtaacaggtgcaaatattcttgctgaaattttatcagaaaaggattcttatagtgcatgttttttacatgaacaaaatataaaatacatagatgttgtaaattatacttctaataataatttatatgctggtgagtttaatgtagatcaggaatttgtaaaatataacgagtatggaaaatcgataggtaacgtaaataaagatatattgaaggataatgaaactctagatagctattgtgttaatttaaatgaagcagcaaaaaaaggaaaaatagattatgtaataggaagagcatatgaattagagagaacaatggaggttctattaaggagaaggaaaaataacccattatacgttggtgatcctggagttggaaaaactgcgattgttgaaggattagcattaaaaattatagaaggtgatgtaccagatcagttaaaaaaaatggtaatatattctttagatatgggtgcattattagctggaacacgctatcgtggagattttgaagagagaataaaatctgttattaaggcaatagaagcaaaggaaaatgcaatattgtttattgatgaaattcatacgattgttggggctggatctactagtggtggatctcttgatgcaagtaatttattaaagcctgctttagctagagggacattaagatgtataggtgctactacttataaagaatataataataattttgaaaaggatagagcactagctagaagatatcaaaaaattaatgttgaggagtcatcagttggtgaaacattaaggatattagatggaataaaatcttattatgaatcacatcatcaagttaggtatactaatcaagcaattaaatatgctgcagaattatcggacaggtatatttcaggaaaaatgcttccagataaagctgtagatgttatagatgaagcaggtgtatattgtaaattgcataacactggtaataaagttattactggaagtgatattgagcatataatttctaggattactgaaataccatgtagtaacttgttgtttaatgatttggatagagtaaaaaatttagaagaaaatctaaaaaaagatatatttggtcaagattttgcaatttctcatcttgtagattcgattaaaattgccaaagcagggcttagaaattataacaaacctttagcaagttatttattttctgggccaactggagtaggtaagactgaattggcgaggcagttagcaaatcatatgggtatgaaattaataagatttgatatgtctgaatatatggaatctcatgcaatttctaaaattatagggtctcctccaggttatgtaggatatgatcaaggaggattattaactgattctatttcaagacatcagtatagtgtattgttacttgatgaaatagaaaaggctcacagtgatatatataatatattactacagataatggattatgggtgtgttactgatacttatggtaaaaaggttaattttcataatgtagtaattatattaacaactaatgctggtgcttttgagttaagtaaaagttctataggatttattagaaataaaagttttactcatggagataatgaaaaagcaattgaaaggatctttagtccagaatttcgcaataggttggatgctataatttcattttcatctttagatcaagaagtgatgttacgtatagttaaaaagtttatttatcagcttaaagagcaattagcaaagaaaaatgtgcatatagatgtagctgatgatgtgttaatgtatttagctcagtctggttataatgatgcttatggtgtaagaaatatagaaaatattatttctaaaaaagttaagaagtatttagcagaagagatattatttggtaaattatttaatggtggaaatgtaaaaatcaaacttgatgctgatactaataagttagtgtatgatttttgttgtgcagaagcataaatttaatatattaaagatattgcttaaatataaaatatatattaaaagtaatgtattatctatatcaatgaactttattttataagtgctatttttataaatattaatgatcaattatatatcttttagatataataatattaattgataaatgtctatcataatatagttaaaatactagtaaatatattataaacacacatatattatttttcttttttaataataatcaactttttattataaaaatcttaatatttattcttgattaataaaataataggtgttagcatcaaaattaatatattaaaatacaacttaaagatgttaaactttaataaaacattatctaaatattattcaattgttgcttgtattgcattttttatgttattggtgcttttaatagtacatttgattagagtatttttgaaaaaggagagcgttattggtcatctagtaactggaattcttgctttatcattactatctattattctggtttttggatctaaatatttatctgatcaccttgaatttaagaataaattattagtagatttatttacagaagagcataaggaaaaagtagaggtacaacagattggattgaatgaggattttgaacgatctataatgcgattattagagttaaagaaattagcattagaagatatttctgttgactttgcagagtctacgcagcacagtcaatcaattttagaaaaatatgatagagaaatagaacatttggaagctctgcaaaggagacaagtggaaataatagaactatcaaatagtttaggagataaatttcaactacaaggttgggagtatgatacaagtttaaaacatatacaagataattttatagagcatattaaacatgaaagatattcacattattgtttttgttgttatttacatgaatttgaggttggtgatagtgtagattttgatgaactttcacctcgtgtgagttctgctatgatatatattacttcttcaccacctataacatgcatttttaaatcagcaggtactttattgactgcgatggggaaattagatgcagatgataatacgttatttgttgagtattgccaaaggttatataattttgattgtaagatggctttacaaattgaaatatctttatctaatagattaaaatgtgacacatatacatataaccatattgactattggataaacagtactagatcatattatagacagcgtgatacattagctattgctttacaagaaggtaaacatttgttgacatctcttgcagatagagaatattcagatacggtttcttcttttaaaagtaggggtatagaaagtacgataagtcaacttgaaaatacactaaatacgcaattaccaaaaggtgagatagataaaattatagagggtagtaacccaattatgcaaaaaatagttagggagttgaatttttttggaaaagataggatggaaacccttaataacgtacaatcagaattgccagaaacattattaggtaggaagattattgatgtcattgaagcagaagaagaattaaaaagtttgattgataaaaaatataatttaagtttagaagatggtcctaaagggaagataaggcagatgatgtgttatcttcaatcaaggtttgatgaagtaaaagatggtttgttagcatattcgcctatgctatctcaggatatttctcaaatacaagcattattagatttagatttgaaaagtagtcctttaaatttgcaatttgaaggtcagcctttaaatttagaagatgtggaaacacaaattacatatctatctaaacgattgtttagggaagaggaagatcaaatagaattattacaatgtgttcaagatgcaatccaatgtactaatggtaaaatgcctcctgatcttgaagagaattttttattaaaatcattagatattattataaaatattattcagattttttacaaggtatacaaacggtattttctaatcagagcgtagcaaaagatgaagtagtgtattgtgaacatttactaaatacaaagtcagcgagtttacaaaaaatatttgatattttatatacgagatatcaatatttagaagaaaattactgtaatcttgaagaagcatcattgaaattatctaaagtacaaacattaaatgcgcagtggttagttgcatttaaaaatgtggaacatgttcatattttatttgagaagttattaaaattggaaagtcaatatagcgcttttcaatatatggtgactagattacaagaattaatggaggcagtgttaggagtcagagatggatcatcttatttacatttattggatatttcagaagatgagaagagtagttttttagctgaactaagtcaacaaaaagaaccaatagaacttttgaaattactatctatgaaaaaagtggagtttagtatgcttaaaagcgagaaactgaaccaattagatggaaaagttcaagctattagtaaatctttatttacttttatagataagagagatgaaatattagtgtccccgattgttgtacagcatctatttaatgagggacgaatgggagttcattttattagtaagttagaaaagttaaaggggacattaacattattatctaatgaaactagacagttgatatttggtgaatatgtaaatgatattgattatattatagattggataaggggagcagtgaatgtcttgtataacaatgataatatttcagtgcaaaagggagaaattataaaaaattatttagaatatttacaacagaattttttaatacacgataaattattaaatttatttaacttaaagaaggaaattaaaaacaagaaagaatcattgcttcctattttagatagattaaagatagcgcttgtgcaaaatgaagagctagatggtgaattagtaaacttgaaaaaagaaattgatgatctaatttgtcaagttaatcggcaaatgctgttaataatagaaaaagatggtgaattcaaagaatttgtcgagttagtgtctggattattaaataggattgatcataaagatgatataccagaatttctatattgtatggaaatatttgatgattcgttagctaaattagaaaggggtatagattgtacaggtgataaagagaattatacgaaatatatacttgaaaatctaagaaacatttctagattatcaagtgaattaaaagcaaagcaaactgaaaaattaccattaggtggtgaacagtctgaattaattgaagaattagttagtattggtcaacaggtaaatattaaagatcaattaagtgtacttgatgatttatacagttttttggatgtagcaaaatacttgcaggaagagtttaatagcttatataaagaagctatagagtcagtgctagaaattgtagatgttgaggaagaggataagagttcttttgtagaattagtaaataataagctgaaatctttaggtaacagtttttcttcatcagaagttgtgagtagttttatgcatcaagaacgtcaagatgtgagtaaattggggcgattagaaagttatatatcaatattaaaagaagaaccaaataaccttaaacagctggctgatcaattgctaaagttttcatcatttactttaccctttacgggagaaaggctgcataaaactttacaagatatgacgacactaaatacactatatgaagttactgattatttaaaaacatatatttctaaaagtcgatatatagaacttgatcaattagagggtgaattgcgtaaatttgtagagtatatgataaatactgtgaaaagtatcttaccacctttacatgaatatgaaaaatctacctgtggatgtaaaagctgtcaaagggtagagcaagaaatgacattatattttaaaatagcaaatgatcttgacgacttgcaaagcttattacagcaagaaaggaaaataataacatttggtgctatacaaaaatttcaagaaatatgcaaaaatatgaaaagtatgtttttagaagataaagatttggttgattccatatcaaatatactgttacacagtgagcactgtaaaaaaatgttggggttagattcatataccactcactttttattatatattaaatttttaatttattctgtaattgaagtaggttttagtatagagcaagatatggttatggagttaaatgttaagatatataggcaagaagtgttagtttcagaattaaaagcaaatcttaggaaagagttagatgagaatatacgaaatttattagatcagccaatatattaccctaaagatttaatcaatgtaagattaataaagagaagatttatagataatggaattatatttgatgatttgatgaaaattttggaagatagtgtaaaagaaaaagtacaatgttcaagtagtgcattagtatccttgatgtgcaaggaaagaatagatagtatggaatgtttgattgatacttatcaaagtgaaaaagtatcatattcctataaattaaagttatatacggcaattcaagagtttatggataactctgtagatcaaagaaatattcaatatttaaaagaaattgatgatggtatacgacaagtgcctaatgttctgctattttgtccagggaatatactactgaaagcgacagatattcatgctctataatacatatttgtataataaagtgttgtggtgttcatgaaaaatgcttttttgtttttattataataatgtgacattaattttataaatacacaccatggactgcagaagaacgtgaacaccagttatttaagcgtgaaaaatatgtggaatttaatttgattcacgatagacaaaatttggtttactaccaaattggtaactctggtgcaatcataatatctatgcctcctaagtcaaatgaaagtaattttatattatgtaaatttcaaaatagcccatctaattctgatgatcataaatatgtgtactttcatgatacacactttttattacatttttaatgttaataataaatatttagttttcaaatttattttaacattaaaaggtgatatttactaaatctcaactgttgaataaaagtcaaatgtatatttcctgttttcttatagataaaaaatgtaatttttattatatttttatttacattttataaattatttcttaaattctaaataacattaattttataaatctaatgcggcttttgcttttttaaagtagacgtattgcctaattattttaatgatttaataaggacacatgataccaaaagaaacagtggatatagatgaaccttccataaatcaaaagttgccattgaaaaaaataatatgccagcaactgatcagaataagtacattatgcacttttattgcgctttttgcttttcttgtcttaacacttgtgcttttcatgagtaagagcaaggatgcagaatatataaagaatataaaaatgtccgctgtaatatgcctaatatgtagtattgccccctttataatagttaatattttccagaacagtaataacagaaaaggtcaaatactaaatggtagtggacaggaaaatgacatgctaccaccatctacttcaaacactttccgcaatacacttactatactgagtacaggagtcaatataatacacagtattgcaatactttgaatataaaaaaatattaaagctagtacttagaggcttagcataatacatataaaactacaatcctccataattcattgcaccaagttaaatttgtcatgcaaaacacacaacaattcagtattatatacatttttatgtaatatgcaatagaatattttttaatttataacaaaaatatagttgccattcctaaaaagattaaaaaagataaagtatcacttgtagcacatatgataatagaagaagatattgcaggatcaattttaaaaagatttaatatcattggtatagctgcacctaagaatgttgcgatagaaaaagtgattatcattgaagttcctgctaatacttgaatatcaacgtgttgtcctcttaacatgagtgctatcgaagacacaatcgctaatattaagccattaatgaatcctacaaataattctttaaaaagtaatctgtgagcatttctattagtaagttgtttagtagataaagctctgattgtcactgtcaaggcttgtaatcctgcattaccactcatagatgcaataattggcattattactgatagtgctataaaatgttgtaaagtattactgaatattcctatgatcattgaactaattgtagatgtaagtagatttattattagccatggtaacctttttataacggtttttgaaagagaagaactcatgtcattatttgataccattcctaagtgtaaaacatctttttcagcttcttgatgcattacatttaatatatcatgtactattattgaccctataattcttccatctctgtttatgactggagctgataataaagaatattttctaaaaatttctgcaacttcttcttgtgtagtgtgtgattttatgatttttatatcagttttcatgagatttttaatgatttgggtactgtttgagcaaataatattgtctaaccttaagtatcctataggatttagtttaggatctacgatgaaaatttcataaaattctttatttagtttattattttgttttaaaaaatttaataactgatttatagtccaatattctggagcaataatgatatctttatgcattaacctaccagcactttcttctggataggatagcaattcattaacatgaattttgttgctttttggtaatatatttaaaatgtttatttgactttccttatcaagatcttcgataattacaacaatgtcttctgtgcttaactgagatattaaagatgctaccttttttattcctaggattttaattatctcttgacgtaagtctggaacaaggtggataagaatatcttttattaagttatcatttatactattaaaaaattctttacgatgttgatatgttgaagtgagtaagaaatatgcaagctgcacattatctgatttattaattatttcttctacaactaggtaattttgtgtttctaatgcttcagttaaagagttactggttttttcatctaatatgtagtgtaaagcatggccactttcctgtgtgtacataataatatagcccttagattattcacaaaataatataaaaaattatcaataccaagtatatacagttatatagataaattctaaatacatttttaatgttaataataaatatttagttttcaaggtgatattcactaaatctaaaccgttgactaaaagtcaaaatttatatatggtatttaatgtttttagcccctatggcggaatggtagacgcggtagactcaaaatctactattcgaaaggatatgctggttcaagtccggctaggggtacttaaaaataaattgttagttgttgcaagttttttttattttattacaatactggtgagtttgggtaatcgttaatgggtttttcccttggtgtttttttattgtaaggtatgagatgtcgggtttagctagtaaagcaaagagtagggttaagagtagcaaaggtaaaaatagcacaaatattcatgctgatgaattaaacgaagatgttggagtagtagttcgtgttatgacagcagtcgtagatgtaaagtttgctagtggtaaaataccaaaaatacttaatgcgttagaaagtaaagaaatttataatggtaagaaattagttcttgaagtgtctcagcatattagtgatagtattgtaaggtgtatagcacttgatggcactgatggtttgtctagaaatgataaatttattgatactggtgctcctatatcagttcctgtagggcgtggcacattaggacgagtttttgatgtactaggtaatacaatagatgaatgtggcccgttagaagaatcaagttactttattaagcaaatatattcagagattcctaagttaactgatcagaaaattgcaactgaaatattggtgactggtattaaagtaatagatttacttgctccataccttaaaggtggaaaagttggattgtttggtggtgctggtgtaggtaaaactgtattgattatggaattaatacataatattgcaaaagcacataaaggagtatcagtttttgctggtgttggggaacgtacacgtgaagggaatgatctttatcatgagatgatagaatctggtgtaataaatttagaaaataaggatcagtcacaggcggttttagtatatggtcaaatgaatgaacctcctggagcaaggttaagggttgcattatcagctttaactatggctgaatattttagggatgctgaaaatcaagatgtactattttttgtagataatattttcaggtttactcaatctggatcagaaatttcagctttgttagggagaataccttctgctgttggttatcagccaacattggcagcagaaatgggtgcaatgcaagaaagaattacttccactaatagtggatctattacctctgtacaagcaatatatgtaccagcagatgatttaacagatcctgctcctgctacttcttttgcacatcttgattcaactactgttttgtcaagacaaatatctgagctagggatatatccagctgttgatcctttagattcaacatctcaagctttatctgctgatgttgtaggtaaagagcattatgacgttgctaaggaagtacaacgtatattacagacatataagtctttacaagatattattgcaattcttggtatggatgaactttcagaggaagataagcttatagtggcaagggcaaggaaaattcaaaggtttttatcacaaccttttcatgttgctgaagtgtttacaggtgctcctggtaaatttgtatctcttgaagatactgttttaagttttaaaggattggtagaaggtaaatatgatcacttgcctgaagctgcattttatatggttggtagtatagatgatgtcataaaaaaagcagaattacttcaaaaggaaggtaaagtttaatgaagtatctctctgttgaatttattactccagatgcttttttagaggtaacaaatgttctgtctattacttcatatactgtagatggagaatttgtaatattacctggacatgaaaaatacattatagagctgcgctctgggattattaaactaaaagttgatacaggtcttagtttattttatatattaaaccccatattaaaggttgacttgtataattgtaaaatcttagcgaatcaatttataaatgcttgtgatgttaatgctgtaatacttaaaaaatataaacaagatatagagaagatattgcattgtataagtgataaagcattacttaaaatggcacaaatgcaattgaattttataaatcaaatagtcagttagtatgaaaatattccttgataccatagatatagattttctaaaagagtttagtgttactggtttgatagatggtattacaactaatccattgttgttatcaaaatcaaatttggaatgttatgatttgattgtaaagatttgttcactgataacaggtcctgttagtattgaagtgatatctacatcttacaaggatatgattaaagaagggttggaaatatctagaattgctggtaacgttgtagtgaagcttcctttgacttatgatggattaattgcatgcaaagttttatcttgtgaacataatgtaaaggttaatgtaactctttgtttttctgtatctcaggcaattttagcagcaaaggctggtgcttattttatatctccttttgtaggaagaatagatgatattggacaaccgggtatgcaattaattaaggatatacgtgatgtttattctaattataatgcatttaatactgagattcttgtagcatctgtacgtaatattacgcatgttatacaatctgcaaagataggtgctgatatagttacgattcctccatctatttttaagcaaatgtttatgcatcctcttactaataaaggtcttgaagattttttacaaaactggaatgcatctggaaaaaaaatattttcttaataaaaagttaatataagttttttatctttttgttcaataaatattatattgaagtaatatttatcctgtgtttatactcgtttgttcatagaaattatgaatatccttgcttaactatattatatttactttagacagcattatactagtataatgctgctaaactaaagttctattcgttttataatttggttttgaataattatttatgttcaagtaaattgtggtatactgctatatatggtagaatgagaaaatagcatgtccctttccaatcttagttcaaaagatgaaaataatgtagttatcgaaaatttgaaacgttatatagaaagaattgagaagctagaatctgagaaagaagaaataagtcaatatattagaaaagtatataatgaagcaaatagtaatggatttaatgcaaaggtaatgaggcaaatagtaaaattaagaaaaatgaatagtgatgatagagaagagcatgaaatgcttttaatgacttataaaagagcacttgggatattagttgaaattgatgaataatttttttgtaaagtaataactacttataaaaaataaaaaacagtatgagtttaaacaagttttatgtattctctagtattgtttttgaagttttaacgcctaaatgttttaaattttcagtacgtgataggatattaccatgtccttctgatagttttttcattgcatcattgtatacattattcaggatatttacttgttttccaagtttttgcatatcagatataaatcctactatcttatcatataatgctccaccttgacgtgcaatttccatagtattacgattctgacgttctaacctccaaacagattcgattgttcttaaagttgcaaataatgttgatggacatactattactatttttttattccatgcataattgtgtagcataatatcttcttgcattgcaagggaatatgcgccttctatagggataaacattaatacaaaatctggagtttttaatttttctatattttggtattttttatttgatagtacattaacgtgtacccttatggatgttataaattgtttgagaaggacattttttgattcctctgattttgttgcaaaatatttttcatagtgaattaaagatattttcgaatcaataattaaatgtttgttttctggtaaattaataatagcatctggttgttgtttgttaccttcactatcttgtaaatccataccggtgccatgcaagacataatcttgatttttccttaaaccagaactttctaatattttttctaatatcatttctccccagtttccttgaattttaacatttccctttaaaacatcagctaaattttcagcttgcaaagtgattttttcatttgcaagtataatcctctgaatttcttgttttaataagaactgttccttattatgtatactaaaggaatcatcaacttgctttttaaataagttaatatgttcttgtaatggatttaatattctacttaaactttcttgagatattttattgaatttatctgttttctcatcgaaaatgcgatttgctagattttcaaaatataacttatatttttcatcaattgttgtgaattcgtttttatataagtcaagtgtatgatttaaagcctttttttcaaattctaactctgcaaccttattttgtatattttgtaatttagtaataaatccatcatttttgttttttaagttatcattttcatattctaacttcttcacttgcttttctaaatcatttttaagcatgttaaggacttgataatcaaatttcgatactctacattttaatgcaatagaataaccaattaaagctatcaataatccttctaagacacatatcagagctattatcatatctgttttatatttatgtattttttacataatacaagaaaaaaaataattattctatatttgtgcttatagtaaaactttattataaataaagataaatttattaaatttttatatttatttattaaaatattatatataatgtctaattattaattaataattagaataaaatgatatttcacatagatggtgtagatgctgataaatctaagcttttgaataaacttattacacataaaaattatatatggttctatcggtcaatatgtattggcattattacaacagataataagtttgttttactaaaagacgaatcaattcctttttattatgaacaacaagttgtaccaagttatatattttttatgaaaggtagagaagagggtgttaaagtatggcattgtgttttaattaaaggatgtcaagtcagccaatttgtagataaaacttccattattattaatatggaaaaggaaaggaatcctataggaataattgttcatatatgtgatatacaagattatggtgaaataatatattccggtataggtaaaatgagtatgtctaatttcaaaaaaaatcttaaagacatatgtaaaagtagtgctaatcctcaattaagtactgttacttttccaattagttattggagtaaattagtacaaaatgttgtagaaataattccgatgcaaaaaataaattatacaagaattaacaataactaatttccagctaacttagaccttaattttttatgtttgtgtattgaaattagaagctattttctcaattatcatttattcagtaatatttgtcatactatataaattaaccatgttatcgttatttgtaaattgtaatagggcattatatgtattttaactgttatgtactattactataaatttagtgtgatataatggataaatttaaataccattacttctacagtagtgttatttatatgtttgtattatgtattatgtagaattttatggatgatactcaaactaatgacgataggtatattggaagtaatcaatattttcaagatgcattaaactggtattgtggtcgttatttattatgtattactgaaagagcttggttgtttgtaatatcactttttttatcttctatattactaatactaatacttgatatattttcatattttccattaaaaacaaatttttcctttaccaaatatacagatcattacacagatgagttttctgtaataaaaaagttgagtaccaataatgaagacagtgaagagacattgttatcacaataccttgttgcacagtatgtaaaaaaatatgaatcatatctatacaatgatttggatagtcaattcaatttcataaagaataattcttcaagaaaaatatatttagcatttaaagaaatgatagcttcccatcattatattgataattcaaaatataatgcaatatcaattgaaacaacaattcataatgtgaagcttttatcaaaagattttacttcttcaaataatgccattgttacttttaaaaaacaaattgcgataaatggtgtaatatcacatgttcaatcttataaagtactggtaaccttttctttatctagtattaaaatggctatatcaggaattatgccattagagtttcttgtacacgactataaaaaactagattaaagtcgattaaagcttataagacaagacataggctttcattataactatgattaaatttactccaattagagttgcatcacactcatacgaactttatgtaaatttgtattattaaggtttgtatctttaatgagcatcatttacaagatgcatgtttgtattgcttaaattagcattataaaaattagcaaggaaataaggaaatatttgatacttccatgttgctattgcttaggttacttcctgatatactgatgaatctggatttactgcgttataggatagtatttgtaagattttaaaattaaatttttgaattatttgaattttccccaaagaagtttgaatctagtaaattacaatttataactttttatctatttattttccataataataattatgtaatttttattgataaaagttttgaacaaaaaagtatctattatcatatgttgatgtatattaaattatatatgtatttttgtattattttgtgatgtataaatttgttttaaaaatctttgttcccataattcttgcagtaatttcatattatataaatcaatcatggataactgaattggctaaagcgttgggagatatttttattaacttactcaaactaattagcttaccagtagtatttttttctattacatcgacaatttctggattggcaaatttgacagaaattaaaactttaataagaaaaaccatattttatactatatctactacagtgattgcagctactgtaggtcttatcacatacctattaattgatccatcaaaaaaagaacttatatataacatattgagtaccaataagcatattagcaatactccagattatttatcgtatttaatgtctatattaccttataacttcattaaggtatttctagataataatgtaattgggtgtgtcatacttgcattccttataggaggagcactgctattattgcctgataaaaataaacgcgaattgcttcataaagtttttgatgccctcttcgatacatttttagaaatagcaaagcttatattaaagctaatgcccatagcattatggtcatttattactgtactgttatataacatgaaggaaggatataacatatcaaatgttttaaaatatctgttatgtatcatgatagcaaatttcatacaagcatgtataatactgcctctgttactaaaattaaagaagattcctgttataaaaacatttcgcggtgttttgccagctttaaccatagctttcttttcaaaatcttctacagctactctaccaacaactcttcgttgcacacaagattacttaaatattccaaaaaagatatcatcttttatactgccagtttgtacaactattaatatgaatgcatgtgctgctttcatattaatcacagtattttttgtatcagaagttaacggatacacattttctattggtgagatgtttttgtgggtgttcctagctactggagcagctattggtaatgcaggggttccaatggggtgctactttatggctatgagttatctcatgtcaatgaaagtgcctttgagtatcatgggagttatattgcctgtatatacaataatagatatgtttgaaactgcaattaatgtatggtcagatgtatgcattactcagatagtacataaagaatatgatgcgttgataaaaaaaggtaagaaaattggaataaatgatcaatgaactatttttagtatgtatcttaatatataagctattttagtaaatatgttaattttaatttcagaagtatggtaagtatttgacttaatttgataagtagtttttagagatcacaatgactttaaaaatagctatatggaatgtcaactctattagaaaaaggttggattaaggataattttaatttatgcttaatttagataattgtttttgctgttcatagaattcttctttatataatgtaggatttatcctataatctgtaattctagattgaggaaaatagaaagttgatgattcttttatataacatgataaaaaacagttcttatgttgcttaaaacttgccgtatattgcttgtcttttctcataaaaaataaaagaaatacaaattagattgtaattatatgtttcacttctttgtatagtatacaggaaatctaatacagcaaatactaaaaaagctaatttagatataaaagatataatagaaaagcggttagcaagatattcagtaataactcaagttatattattattttttttttaagcacatataataactaatactaaatcgcactaaaaatagctactaaatattagaaattaaaatgtacttaccaaaataatttattcttctgtacaaaaataataacaagtactattgcacgacatactacacaattaataaataattgaataacatcagacaaaataaacaggaattcttgaattattgatatccatactgaacatatatcacaacaactattacaaaaaagattatatgctttatgttaattagaactatcaaagtttttctcaaaataagtttttgcaaaatattactatccgtttatattaaggcactgttttttattattatacattcttttttaatggataaaatttgtagcaaattgtcaatccaatagagtcaaaaagtttattcttaatagaacattcatttttgataaattcttgctatagatgtatactagaatttattactagaaaaaaggattttattcagataaaaaaggtagaaaattaatcatctatatggttaagcataacgttttagcaatcttgattaatcctagacgaagctgattataactcttaaaaccaggaagatcacattttagtaaatagtgtcagtttacattgcaatttatcatgtcttaaagatgtatgatggattattaatattacctcagtactgtatgaatttcatatataaattattaaaattatttgataacttcttgattatccatatattttcttaaaatatgcggtattgttatagaaccatctctattttggtagttttctaaaattgcaataatagttcttcctattgctaaagcagaaccgtttaatgtatgtacaaatttacttactttaacattattaattatagtagtatatttagtattcattctacgtgcttgaaaagctttacaatttgaacaactagaaatttctctgtattgattctgacttggtatccatacttcaatatcgtatgttatacttgctgaaaaacccatatctccagtacacaacatcattactctatatggtaattctaatctcttgagaatttcttcagcaatttgtgtcattctttctaattctggtgctgattgttcttcagttacaatgctaactaattctactttattaaattgatgttgtctcatcatgcctcttgtatctctaccagcacttcctgcttctgatctaaaacatggagaacaagcagtaaatcttagaggtaaatcacatccattaatattcatatttgataccaaattggtaagtgctacttcacttgttggtataagtctaaaattttctgttgttttaaaggaatcatctgcaaattttggtaattgtcctactccatacatagcagattcatgaactaatattggatgagatatttctgaataaccaaattctttagtatgaatatctagcataaaattagataaagcacgatctaattgtgcaagctgatttttgagtattacaaatcttgatccagaaagttttgcggcttgtttgaaatccattaaatttagattttcccctaattcataatgagtctttattggaaaatcaaagcttgttttattcccatgtcttctcaattcaacattactgttttcgtctttcccaataggtactctttcatctggtatattcggtaacatattgagaagattaactaattgagaatcttcttttatcatattgttaatatcgtttattttacttgttacattttttgataattctatttgtatgttgcactgaagattatttttttttaacttttcaatctcttgagtgatttgattacgttctttctgtaaagagtatagttgtgttaataaatgtcttttcttaacatctaattctataattttttttgcaactttttcagaatttcgtacttgcattgcattatcaaataattctggattctgttttataaaatctatatcgtgcataaaattcaattatttatataatattgtatcttatcttatacgtggttatgttaaaaaaaaacaaaaaatcttaagtatatgttccgtttatattaagacactgttttttattgttatacattctttttttgaaggacaagatttgtggcaaattgtcatctccagtagagtcagaaagtttattctcaatagcatcatttaataaatccacaatttcaaatggaccatatttccagtcacatgctaacttcatggctttatcaatggctgatatcgaagataattcaggaattaaagatgaaatatagattaaagtattagaccatacataccacatgaattgcccatatttatcgtgaatatcaaatagatcttgaatgtttttaaagtcatgattaataatgtatgcttttctatatagtccagtatgtaaatctataacctgattactattgccaccatataactcataaaaacggtaaaatccaccaattttgcttgtagagccagtgtatccatcggaaatcatttgtagtactactctaggtatggcgttatataatttatgtaagtgatcattactgggtaaactgtttattaaatgttttactgtaagtatgaaattgtctagacctatttcatctagtaaattgaatgccccattaggtattcccatgtatttattcgttataatagaatctgcatcttctatattaatattgaatgtataagttcctattagcaaaatcatggaccagaatgatagtattctatccaatataagccctgaaatgttactgcatgtaattacattagagaaactattgcttaatatttcaatgcctttattttctaaactattatagtaagcacattctattaatttgactgtattagcataataaaagaaggatactattaggaaatgacaaaatgtgttgtgcggtattttgctaacaacatctaaaaaaaaatttgaagtagccgatatgataacattattgctcacatggggtaatattttgttgtatgtgttatatattagattataatcttctcctgatttttcagaggtaatattaataatccattctacatctttaagacatgataaattgccatttaaactgacactatttactaaaacatgatcttcctggttttgaaagttataatcagcttcgtctaggattatcaaaattactgaaatgttatgcttaaccatgtagctgatgagactactactattgattttttggaaacctacaactgctacctttttcatctgaacaaaaccctttctttttagtaataaattctagtaaacacctatagcaagaatttatcaaaatatttagtaaagtaaagatatatactaattaagcaccaaactcatcttctatttttttcacaatatcttctggaggattttctccccaaccggaatataatatttgcccatataaagccacatctatggagcctgacctacttttagcaagaaacatctctcttttgggtttatctaccaatacataatgccaagcagctcttccattatcttttccacgtacgagaaataggcaatctagtctactcttcttagtagattctgcaaagtttttgttgtttaatttgctttttcttaacaagttttttgaatcggaaaaaggcacttctttttcaggcttatcttgtaatatactagagaattttgctgatttattaggcaaagcattaggatttttatacttttcactaaaacttgcagcattaccttttctattagcagcaaactgcttagtaaattttgaatctttatttgtttcatcacccatctacttacacctaccttgataaaatcatgtattgtaaaataaccagtttataatactatatgatatattttatacatacaatataagttaacttaattatgcataattaacatgaataatatattaatcattactggacctacagcatcaggaaagtctaagatatctatgaaaatagcgcaagataataatggaattattgtgaattgtgattcaaagcaaatatatcgagaaatccctataattacagatcaaccgaatttgaatgatacttctgtagaacacaaattatatggatatgtatcagtaacacaacaatattctgtaggattatggatagaagatttaaaggatgaaatatcatccattatacaacaaaaaaagtttccagttataactggaggtagtggaatgtatatcaatagtctaatatatggcttatcgcaaattcctaagatagaagatagtgtaaggaatgaaacaagaaggctatttaaaactctagggaaaaaagagttttatgcattattaatagataaagatcctatagcaaaatgtttacataaaaacaattcacatcaattattaagagcatatgaagtcatagaacaaacaggaatttccatatttgtatggaaggaaaatgcacctcgtgaacctatatttaagaattttaagctttgtattcttatgccaccacgaagcgaaatatataaaaaaataaacgaacgttttattaatatgatcaatacatctgtaatagaagaaatagaaaatttgctttcactgaatatacctgcacattttcctgcaatgaaagcacacggtgtgccagaaataattcaatatttacaaaataaaatcagtattgatcaagcaatagaaatagctcaaaaaaatactaggaattatgctaaacgtcaatatacatggtttaagcatcaattccgaaatgcattattctatgaatctcaggatcagttgttagaatctataaaaaacagttatgtatattataactgaattcaaaactgttcgaattaaaacaccttaatccaataataatgtcatttcttgtcttgctctatttttttgtagcctttacaatctacatttagattttttatatttgtagtaaggtggtaaagatacttttcacactaggaaaatgttgaaattcaacgagattggggaagaacgatattagaacaaatattagaattctggtttagggaaaatcaagattatgtcttgcatggcaccagtatcgctttacaagatagtaatgaaggtaataaacaacaaccagatgctaattactaatttaccacagaaaacaaacacttaattattgaaaagtaggctagattgcccatttttctcgtacgtggaaaagataatggaagatctgcttggtggggcattatgtattaatagataaactcaaaagagagatgtttcttgctaaaagtagatcaggattcatagatgtggcttgatatgggcaaatattatatttcggttgggaagaaaaaccctccagaagatattgtaaaaaatagaatttgaaaatatctttaattcactatgaaaaatattttgcaacaaaatcataggaatcaaaaatgcccttctcaaacaatttataatctataagggtacatgttaatgtactatcaaataaaaataccaaaatatagaaaaattaaaaatatcagattttatattaatgtttatttctatagaaggtgcatattcccttgcaatgtaagaagatattatgcatatatagtgatgcattggataaaaaaatttattataagtgtattgtcttttctacttaattagtattgttaagttaaatgtttatttttcaggttgttatagttagtattgttactgcttaatagtatttaatttttaaaaaattgttaattagtaaaattcgattttttttttattactgtacagatttatgtaattcaccttccaattgatcaagttatatgtattgatttttagaaatatatgtttttaaataaccaacaatttcatatagtttctttattgatcatgtcattactcttctcatatttaatgatagattaattgcattaggatattaatctaactttttgtttttgtatattttagtaatttttcactgacattataattaaaaatataaaggaattaaaaagatatcttatttaacttttagtcaacggtttaaatttagtgaatatcacgttgaaaagtaaatacttattactaatattaaaaatgatgtaataaaagtgtgtatcatgaaagtacacctattcataatcatcagaatgagatgggttattttgatttttatataataaaaactatttccatttgactataggaggcatggacatcatgattgcatcagagttaccatttgtcagtaaaccaaatcttgtacctctatcgtaaattaaattaaattctacatatcttccacgcttaactaactgatactcgcgctcttctgcagtccatggtgtatgtagatttctctttacgataattgggtagatatctaataaaaacttacctactgcctgagtatattgaaagtcagcttcccaatttcctgaatttatattatcataaaatataccacctataccacgtggctccttcctatgatgtaaaaagaaatactcatcgcattgttgcttaaacttctgataatagctcttatcgtactggtcacacatttcacgtagattactatggaaaagttcttggtcttttttgttttcatatgtaggagtcaaatctataccacctccaaaccaatttttatctgatatacaaataaatctagtattcatatgtacagctggtacaaatggagagcacatatgcgcaacaacagaaattccgcttgcccaaaattttttgtcttttcctataaaagtattagataactcagaaggatttacagcatgagataattcatgattttgttccatatctccatatacttctgaaacatttattccggctttttcaaaaaccttaccatatatcactatagaatgccctcctccacctccaggtctttcccaatgcttatgatctacttgtggtataaaagatgaaaactgtttctctattgatataaactcagataagagctgattttgtaatgtcttaaaccagtcaactgctcttttttgttttgctttcataaacttaaaaaaaacactaaattgtgatacagtaaaagtatactcttataaaaaagaaaatattaaaaaaactaataagatattattcaacataaatataagtaatttataattctgtaaagaattatttatggaatgcaatattatgattaataaccaccttagtgttaaaattttattataaaattgataattatagtaaagttatataaaaatcttcctgtaatataaatacttaactgcaaaatgtagaaaaacttgtactctaacttttgctgtacacttaaataagatatattttggtgatactaggaaaagacaaaaaattttgggcaagcggaatttctattgttgcgcatatgtgctctccatttgtaccagctgtacatatgaatactagatttatttgtatatcagataaaaattggtttggaagtggtatagaatgaacatatattgaaaaacaccttttaatatgttattttatataaatcaatcgtgtttttttctgttagaaacttagttttgctcctatcaatccaatatagccagatttattagtatcagttctgtcaacatcgaaaaatacaatatcagcataaagaatcatattattacgtaatatcttctctatacctaatgcacatgctgataatgcatgttttgcataattttcaggagaagtcttaaggtttacctttttacctccatagaagtaactgaggccaacattaaacaaatcattttcaatctttaaacctaaatcataaaattcactatcaattattttataatgattagattgtacagaaatttcctttttaccagaattaccaagattaccatacgatcctataaaagtaatattattatattttagtgaaaaaccagcattataagatagtaaattattatattgaacctgttgctgctgattactagcaggtaacagatcatttacagcatgttcaacaactcctgatatagaataaccaataccagatgataactgattttgatatttgactcctacactaacaatatttttatacacatgggatttgatattgtttgcaatatcctgaatcttatcttttggaatatagcttaacccaagctttattcccttaatttgtggagaataataactaactactggaatagcagatccgtgataagcaatatatagacctggtgtgaataaaacagtatcttctttattgtgtccataggaaaaattagaattgtcagttcttagattaacatattgtaaccaacttccagtaacaccacctgaagctactgatatatctgaagatgaaagtttcattttttgtgaaacaggacttgtcaatcctacttgtaaacttccgatattagaagatttaataaagacatatgcttcttttgtattactatttatatctaatatagaatcttttgcattacctgagctgtctatactattactcattaggtttgtgcttaattttagaaaaggcccaacagaaaagtaatcattaatgtgatatgaatactctaaagtggaagttgcattaaaggacaaccttgaaaagtcattgctattaaaaccgtattgtagatttaacttaccacttaacgcaaagtcattagccgtagcttgatttataaataacattaaggaaaatatagcagatatatataatagttttctacacaccaaatctacctcacatgacagatattaattaagatattgaggtaaaataacattagttattaaaataatcaagatttttcataataaaaaattattcttactttaatatataatatattatattattttttatagatattgtacttagtaacagcatagcacagtgagtaagtaaataaacaaaatagaaaaatatttaaaactttacaattataatttttgatagattatatatctgtatttaataccatagtaccagttccatgtatggtaaacaattctaacaacaatacgtgtggtattctaccgtctattatgtgagctgatccataaccttcttttactactttaatgcaagtttgtaacttaggaatcatacctgcatttgctataccttgttctattagactttctgcattacttactgatatttcagataacaagttaccattaacatcagtaactccaggtacgttcgttaaaataatcaattttgcagcagcaagggcatttgctaatgcaccagctactaaatctgcatttacgttataagtaagatcattttcaccactacatacaggagctattactggaataaaatcagattcttccataaaaaataataagtctgtattcacctcatgaggttctccaacaaaacccatgtctagtattttttcaacattatttgactgattttccttataagtataacaaactttttttgcttctattaaattagcatctttaccacataatccaatagcattacctccagctttgtttattagttgtgtaatatctttattgactaatccacataataccatttctacgatttccaaagtttcagcatcagtaactcttaatccattaacaaatgtacttttcttatttatcttctctagaaattcgttgattttgctgccgccaccgtgcacaactattggattaatacctaattgttttaacaatacaatatcgtgagcaaaattttctgctaattttctatccttcatagcagcaccaccatatttaatgataaatgtctcaccagaaaactgctgtatatacggtaaggattctgataaaactcttgctgcgttaaaccaatcagcatttccaccaaattgctcaatgtttgatacaacatcttctttattattattttttaatacattgtgcaatttcataaatcaactcctctattccttgtttacattgactactagtactgatgattggatacataataaaatccaaattaagatttttaatataatttacgttaacatcaagcatttctttttttattttatcaatttttgttaatactaattggtaatgtatttggtgtaactcaagccaattgataaaatctaagtctatttccttaaatccaactttagcatctataagtaatataacttttaataggtttctactatttagtagataatattccataagacataaataattattgatagtagttttatctgctttagaatatccgtaacctggcaaatctactaataccataaaatctttgttaataagataaaaattaatttgttttgtacatcctggtttagaagatgttttagcattttttttattatttgttattgcattaattagactagatttgcctacatttgatctaccagcaattgcaatttctggtatagaaaaatctggtaaagactttatgtgagtagctcctatcataaattcacactttgacattatagtttttagcttcatgcagttaaatgcttaattataaaaatattaaaatatataaaaaactatgcttcaatactatcacatataaaaatttaaagaaaaaaattttgcaattaatattacaaatgatattatctagcaaaaagtagataaagattattaattgagtggtgacaaagctatgagctttgataatagtttagaagagttgtctcaaaaattctacaaactaaaaagtatgttagaagatccaagtcaattgagtgtggattcctttgttgctgcttcaaaagaatattcagaattattgcctgtgatatcagtgatagaccaatataatatcttacaaaaagatatagcaggcttagaagaactgataaataatccagaaactgatcatgaattaaaaagtctagctaaagaagaattctatgaacggcaaaaacaattacctaaagttaagcataaattaaaattatccttacttcccaaggataaagatgatgcacgtaatgctattttagaaattagagcaggtacaggtggagaagaagctgcattatttgtgactgatttatatagaatgtatacaaaatatgctgaacaaaagaattggaaatttgaacagattaactcatcttcaaccggtataggcggacataaggaaatatcattatgtataagcggatctaatgtatttgcaaggttaaaatttgaatctggagtgcatagagtacaaagggtaccggaaactgaagcttctggaagacttcatacttcagctgctacagtagcagttttaccagaaattgaagaagtagatttaaagatagatgaaaaagatttaagaatagatgtatatcgttcaagcggtccaggaggacaatctgtgaatactactgatagtgctgtacgtattacgcatataccaagcggaattgtcgttatacagcaagatgagaaatctcaacataaaaataaaagtaaagctcttaaggtattaagagcaaggctttataacctagaaaaacaaaaaagagatgcagaaatttcacaaatgagaaaaagtcagataggatcaggagaccgttctgagcgtataagaacttacaattttcctcaatctagaattacagatcataggataaatcttacattatatagattagatgatattatgaaagaaggaaatttggatgagtttattgaagcattaatagccgaagatgaagcaaataaattaaagaacctgcatatttgatcaaaaaaacttttacaaaccagattagattactttttaaagaattactgtagggttcatcaatggcttaatattagcaattgtgtcttttgtagcacttatgttaaggaaaacacattgatattcatttatatatcattataatataagatttatcctatgatctgtaattctagattgagggttgtaagttgatgattcctttagtatatgtaataaaaaacagttattatgtaagttattaactactattaaaatatatgcttaaaacttgccatatattaatgtttgttgtgtttacaggacaatatatctcaaatttgtactgctgttctttgatattacattaagttcactttactcttgccttttctcataaaaaataaaactttttctcaaaataagtttttgcaaaatattattatccgtttatattaagacactgtttttattattatacattctttattttgacggataagatttgtggcaaattgtcatatccaatagagtcaaaaagtttattcttaatagaatcatttttgataaattcttgttatagatgtgtactagaatttattactaaaaaaaggattttattcagatgaaaaaggtagcagttgtcagatttccagaaaatcaatagtaatagtctaatcatctatatggttaagcataacattttagtaatattgattaatcctagacgaagccgagtataactcttaaaaaccaggaagatcatattttagtaaatagtgtcagttaaaatggcaatttgtcatgtcttaaagatgtagaatggatcattatattaacttctaataattttacatattttttgctagataatattattagtattatatgaatttcatatctaaaaattatttgataacttgcaaagcttgtttgaaaatttagagtttcgtatagcaaatacatggatattgtaggaatgtgaatttttagaagtatagtatatggtattaaagcatgaatattaatacataatcacagaaaaattcagaattatagagattgtcaaaatataaaataaatattgaatatattacatgcataataacatgagaatgttattttacctcaatatcttaattaatatatgtcatgaactatactatgtaatatttaaatatttcttttttggattttatatactacaaaatgtacttttgataaataaaaattcactaataatgcttaagtaaatagcactataaatataaatgattaaacagaatatctaataataataccaaaaatattttatgaaaagataaggatggataatcacatataaagaataatctagtgtaaaaacacattaaataaataacttacgaatctgtaaaacattgataaaaagtttattaaatgcaagtttactctataaaggtaaattatcatgtttacgcataatcttatgtactttctttttctctaaaaattgtaaagatttaaatagatgttctcttgtacgtgacggtactataatatcatcaatataccctctagaagctgctacataagggtttactattgtagtacggtattcatcaataatgtgttgtattttatctttatctttttcatttctaaagattatttcaactgctccctcagcacccataactgcaatttcagcatcttgccaggcataattaacatcaccacacaggtgtttagaattcattacgatatatgctcctccataagctttacgtactattacactaatttttgggacagtagcttctgcatatgcatacagtaattttgcaccatgtgctatgataccagaatgttcttggttgacccctggcataaatcctggaacatcaataaaagtaataacaggtatattaaaagcatcacaaaagcgtataaatcttgctccctttcttgaagcatcaatatctaaacatccagccaaatgtaaaggctgatttgctactaaccctacattataaccccctattttgccaaatcctataataatattacgtgcgaaatctggttttatttcataaaatagcctttcatcacatactttttccaataactcatacatattatatggagtagtactatttttaggtactaatgtatttaaagataaatcttccatatttataaaatttgaagctgactgagatcctattgattccatattattagatggaataaaattcatgaatctacgcacttgcaataatgcttcaatttcattatgaaatactaagtctgcaataccagttttactagcatgtacttttgctccaccaagatcttcctgagtaacttcttcatatgtaactttttttattacatctggtcctgttacaaacatataagaagtattacgtaccataaaaataaaatcagttaatgcaggagaataaactgctccacctgcacaaggtcccataattaaagatatttgtgggactactccagacaagttaacattacgttgaaaaatttctccataaccggataatgaatccacaccttcttgtattcttgctcctcctgaatcattaataccaattataggaattcctaatgaagcagctttatccataatattgcagatttttttagcatttgattcactgagagatcctccaaaaacagtaaaatcttgagaataaatacatacttttctaccattgatagtaccatatcctacaactacaccatctcctggtatcttagacttatccatagaaaaatttacacatctatgctctacaaatgctccatattcttcaaaagaattatcatctagtaagacagttagtctttctcttgctgttaacttacctttaagatgctgcttttctattctagacaatccaccaccattatatgattttgattgcctgttatttaaatcctgtaaccctgcaaaattcataatatccaaaaagaaatagaagtattagaatactcttatcacatttcacaatttatatcaaacatgtaaactttataattatttttctttattatatagatgaaattctatatacacaatataacagaaagtgattgattataataatctgacatttcctaatcctgtagcacttacttcggttaatgtaccagcacaatatatagcatcaactattttaccatcttcatcacagaaattgaaacgtgaacggacagtgcttgcattaacttgaggtataaaagttgcattggtttttacgtcacaaaataattgtttaacactacggccattagttgctcctccaccgatataattttctttattgaaaaaaaaacatggcgtgtgttctgtacgctgcgtaaaagatttaaattcatttttactgactgatagagctacaaacacttcttcattgttgttattgagaccagacaatataataatttcattaagacaattgttacttctgacaacacaatatttagtaaacaaagctccatataaagtaggatcatagtttggacttgcacttggattagccgaagtatctcctattatactttttaagactgggtcgttagtaacaaatgtatcattttcagatctatatgagtctgcactagataaaaacatttgggaatttttatctaataaaagaattagtaattgcataacctataacactaacattaaccattattctataataatacataaaaaaaactaaagaattctattcttttttttataattttataaaattactaacttattacattaattaacttaaaaacatatcagtttttgattacattttacagatttttatttatcgaaagtacattttgtactatataaaacctgaaaaagaaatatttaaaactacatagtataattatgcatgtaatatattcaatttttactgatcactattacatgattgaaattacaatttaatgtgtaaatcaacattatatgataataataagtagaacatattacagattactttatacttgttacattaattcatttaaaaacatatcagtttttgattatattttacagttttactgcttactattacatgattgaaactataacttaatgtataaatcaatattatattgtaataataagtagaacatattacagattactttatacttgttacattaattcatttaaaaacatatcagtttttgattatattttacagttttactgcttactattacatgattgaaactataacttaatgtataaatcaatattatattgtaataataagcagaacatattacagactactgagaattgaagactgagtagttactgattcagaagtaacactacttagagataatgttgggatatttccattatttctcggtaaagtctctgctactgacttgctagtatgactttttaatacaatactagattcaccatttctttgacgtcgtgataatacagaataatgttcttgtacacgagaatcacctatccgcgttacataacactctcgttgatgagaatcatttatttttacatgatacattgagtgatcagacctgtcttttggtattacataatgctgtatagattgttcagaaacacttattggcaaaacatagtactcactctcaacattattgatatctacaacataggatgagtccacattattgtttcgtactttacaatgcatttgttgtgtaacattacttgtcgatgcaacattatgttctaactgcatagaattatcagataacgaattaccatgctcttcactatgggtaacagtattttgcctagaagagatatttaatgatgatgataattgattattaaacgttttattttgtacataatataaagtattgtgtttatcaaaaaatttataaaaatacatgtcacgggagtgatcttcagtaggaatatttgatacaacacgttgtatgtaatgatcagtaaatgttacagtaaacgcttctgtaaattttaaattaacaaatctacgatatccttgaatatctctacgaaatgcatgaccataatcatatataacatgtccaatacaagatacagaactttttgaaaattgaaaacctttaagtatatcattaaagcttaaattaggactaaatggaataattaaaaatgataattcatttctatgcataccatagaaaaaaacatagttatatacacctaatggattttcaacaagatgaaaatcatcaaatttaacaccaattaactcatctaatccatcaccactatttgtagaattatgttctaaaacacgattcaaatcatcattacatgtatagtaagtattaagtgatttattaaatttacaatggtcactgacacataaacagtattctcctgtttttaactttagtaacgtgagactcataatattttttttatttattaatagatattaataatattatataattactaaataatatcaataattattaattgtttattaataaaagtagaataactaatatttattttaataatttttagcattagtaaaaataatagatattaaaatattgttttatcctaaattgaacttagcatacattgatctatcttataactgacagtatggacaaaaaaaagtgcttctaccattttgctttattaccaaaatagaactattacacttataacattgttgtcttgtcctgttatataccaaaaaatgattttgaaatgttcctcttattccaaatggtgatgtgtaatcttttatacttgatccaccattttctattgaatacaacaatatatttttaactccatcaataatattattgcactctattattgataaatcttttacaaacctattaggtgctattcctgctaagaaaagactttctgtagaatatatattacctataccagtaacaaacttattattcattagcaaggattttatagtacaccttttgttagaagtgttatataaataattagtattgaattcatcagatagtgcatcaacaccaaaattcttaaaaaattctatatattgactataagttaataatatcactattccaaatcttcttggatcattaaaaataagcaaattgttattgctgaaatgaaaaattacatgattatgctttttttgttttatgtagctttcactataaatcaaattgccactcatacctaaatgtataacaaggtagtactgattactaaggactaaaacaatgtacttaccttttcgaagtacttgaaatacagaactgtttacagcaatatcacataggttttgcgtgactggaacacgtaagtcatacctattaacttctatatctaatatagtcttacctagaatctgactagataatgctctacaaactatttctacttcaggtagttctggcattttttacttgacgctgtttatttttcctacgtagtaaattagcctttagtgcgttagataatgctttatttttatcttcatttttaattttttttgacttatccataataaaaaaataaaataaaacctaattaagccgttatagcttagtggcaaagcacatcattggtaatgatgagacctaagttcgattcttggtaacggcactcacttattagcatatatattttttacaaaattgcaaacactataatatagagtgtactttctccatttgtataatcctacagttcttcaattataacaatactgataattaacaaaaagaacccaattattttataaagtaaatttttatctttttatatatttgtattattgcttctctcagaatcacgataacaacactctttatcacaaaaatggtagattatttactacataactacttaaaaaaatatacataaaaatcttataataagtgattatggaataactattgaagaattaaaaaatattttttataccataaaatctatcaaatcagaacctaacagtaaaagttataaatcccattatgatattgcctcttttaataacatttagttaatacataaaccaataatactatatcaaaatttactttactgttgctggtattataattcgatacatcattatataattactttacaaaaatgttgaaatataaaacaattctagtttttataagatttttttatgtcacataatgtaataactcgatttgccccttcaccaactggacatttacatttaggaggagcaagaacagctctattcaactggctatatgctaaacataacaatggaaaatttttattacgcattgaagatactgataaaaaaagatcatctaaagaacttatcgactctattattaatgcaatgtcttggttaaaaattccttatgatggggaaatagtattacaatcaaaaaatatatctagacatattgaaattgcaaatcaactaatattaaacaataaagcatattactgttattgttctgaggaagaaataaataaagaaaaagaagaatttagtaaaaagggtttatattataaacacaattgtatatggaaaaacaaaaattttacaattgataatcttactagagtcattagattaagaagccctactgaaggtgtcacatcatttgacgataaagtatatggtaatatcacagtaagtaatacacaattagatgatatggttttattgcgttctgataacactcctacatatctcctatccgtagttgtagatgaccatgacatgaatattactcatattattagaggaacagaccatttaacaaatacagcacgtcaattattaatatataatgcattagaatggaatcctcctaaatttgctcatattccattgatacatgatgaagatggtaataaattatctaaaagacatcaagcaattggcatacatgaatataaaaatttaggtatattaccagaagcaatatccaattacttgttaagaatgggatggagtcatgaagatgatgagattattagtatggatcaagcaataaagtggttttctataaagaatatcggacaatctccggcaagattagataataaaaaactggaatttttaaacaatcactatatcagtcttactgaagatgaagtgattctgaatatgattattccaattatagaaaaaaagataggatatatgctaaatgaagtaaaaaaaggatatttattaaaaggattatatgaactaaagaaaaggacaaaaaatctagtaaatttagcaaacgaatctttgttttacgttgaagatgtaccaatctctattgatcaagaagctagtgctattataaaagattataagcacgtgttttctatattatataataatttatcaagaatttcagaaaaagaatggaataacagcatactaacatcaacaataaaaaacatttcacaaaacttagatataaagattagtaacatctatcattgtctgcgtgcatctattgttggaagaatgaatgctccaagtattattgaaattatgattaatcttcaacaagaagaatgtctaaaacgtataaagtatgcacaaaatatagaataagcttcctcattataatcttgtacaaaatgctactttaaattattgtctagaataacttatttataaaaataatacataacttacataaaatacaatttttgcatagcacataagtatgctattaaaagattacatgttgtaaaaaattaatatagtattttattaaatcttctaatatcggaagtttacaagtaggattgacaagtcctgtttcacaaaaaatgaaactttcatcttcagatatatcagtagcttcggtggtgttactggaagttggttgtaatatgttaatctaagaactaacaattctaatttttcctatggacgcaataaagaagatttcataccaggtctatatattgcttatcacggatctgctattccagtaattagttattattctccacaaatcaaggaaataaagcttggattgagttatattccaaagataagattcagaatattgcaaatgatatcaaatcccatatgtataaaaatattgttagtgtaggagtcaaatatcaaaatcagttatcatctggtattgattattctatatcaggagttgttgaacatgctgtaaatgatctgttacctaccagtagtcagcagcaacaggttcaatataataattgaactataaaaaaagttctaatgacgctaattacacaagtttcaaaaatctataatacaagaaaattataaacgcataaaaatgaatgtatgtatagaaataataattaataaatattaataaataaaaaaattattaacattttatataaaatatattaatttactttaaatgtattaatatatattaaaaatcttatgaatctaacattattaaaattgaaaacaggaaaatatattttatgtgatatttatgaatttcatgaatatgatttagacagtgatttcactaacgatcactatacactagatcattttatcgggatgaaatttgaagattgttatttcattgaaaatacactgtccaagtattattacgcttttttttatggtatgcataaaaataatttattatttttggctatacgaattaatagaaatataagtaataatcagctgcttaaaagttttcaattttcagaacgttccatttgttgctttggtattgcaactcacattcatgacttagatattaaaaaaagtatgcatcaatattaccattttatacgtcacgaaaaccctactattcaatttacaagattatttactgtagtagcagtttctcattatataaagtgtagcatgttacaatccatttatgatgacaataatcagaatagtacttatagtatatgcgtttataatttttttgataaagaaggtaagatatattatcaacaatacgaacatcatactgcatatccattatatattttgttaaactttgaaaaaaatataattatctgtgataatgcactgggtggtttaagaagatataaaaattacacatgtcacaatgtaaaatatggaggacagtgtaaaggaaacataggatattttcttgaaaaatcaacgaatacttttatgtgtgtagagcatgatgatatattagagagtaatcaattatcatattccactaaagtagctacttctagtcaacaggaataccatcctctattaccatctacaagtgaagttgaagtaccacaaattaaccatgatggattagaagatgacatttcaccaagaaataacgaaagcgctccagggttatttgttcacaatactgatcttgaaccattaaccgttaaatttccattcagataggtatgtatattaatattccgtttattgttacaatacagtactataattagtattactataaaaactataattaataatattaaagttattgctgtgccgcattgatcttgatattactgtatttaagttatgtaataataagcagtaaaattgtacaatagaatatgaaaatcatgatatatagcaataaccataattttttaatgtataaaaaattcagagtgctttttgcaattgttgggataaagtatcagttattaaataatattgttatgtatgatggacatagatgttttattggttatatgaaatctaaaaacaatattaattttttaatagattagatagtaaaatagcaaatcagttttataaatatataattttgaatcccaatcagcatacccttactttattataaaagtaaagagacagtaaagttacagcaatagtatactatttaaagagaataatgcttcttaattaaagaacagtttataatataaaaaataactaaactaagattactactataaatgaatgtttttatttaagtatttatctggtaataagtataagtaatatataattatatattaattttttaagtaaaaattaaacaatagaaatataaagatttattaaaatattataaagataagtgcctatattaatataataatatacatttaaaatgtaagatagcagctgtatatactatactgataataaactacaaataattgatactagttgcaatacttgcaatactactgacaattagtatataattactagtgtattttcatgtgtttaatggttataaattatgttagcaaaattaccaaaagtgtcaaaaagtaaatcacaggagcaaaatgaaccgtggcaacaaaatgaaacaccggaacaaataaaacaacgagtccagaatatcatatcaagtccaggtgtagataatgatgatgcagaattaatatgcaatatgatagataagaatcacgtacaagatctactgtatttacgttattatgtacaaaatttaaaaaacgatccaagaatgaaattaaaatctataaggtgtgtgggtaatactaattctaacactggagaacttaccttatatattggagataggaagaaaataccagtaataccacatggaacatctatttttagagtaactgttaatatattaaataatgcacttaacgacaacccatttcttaaggaacttaatgtaatatcaaacaacaacgattcttcatgttttgatttatattgtcttgtactcgcaacaaacatgaccaattttaaatgttctacccaaagtaaaggtaataatgactttctggagtttagtgaattaatgcttgtccatccacagtctggaaaagacggtaaacatttaactccacatttcgaggagaaatatttagcaatgcttggatttcatgtatgtttagagcctattgttcttaaaacagacgaacaagaagcatctgaatgtgatgaaggggcttctcctactaaatctccttatgcatctaatgacagcattgcttctagttatagtacatcttcttctttagaaacagtaggtatgtcagaggaagaagatacagatttaaatccattaactccttcaccacatgtcttgggaccatcactttatgaacctatgttctttccagatacaccaggaacacctaaaacatctagaagaagtaagtaaaccataccagtaattacttaacataaagtatagaatatgtgtatttaataatactattttactcatcaatactctgtaaattttactattataaaaagcttactacatgcaaaaaagtacatgttaaatctgaatcagaagaattagagtattagctataataaatacagtatgtgatatttatttgatatatgtattttaagctaatacaatcttctgtaggtacaccaaaaaagtactagtaatctattgtaaagtacaagttaaagaagtaatacatacttaaactaaaaggtttacattttttaccacatatctttgctaaaaaataaaaacatatctctagatatagtatttctagcttactttattaagcacttgtaatttggatcacatgtagatttttcttgcaaaaaataaaaactacattatacaagctaggtagaaatacattatttacaatacaggaatattagtgtttaagcttttcatacactgtattttctacagctgccctagctccagaacttactaatttatctttatatgagatgaaaaatgatttattatgcagacatttgaagaggacacttgaattttaatcttatcaaaataaatcaagcatcatgtataggtaatatactactcaacagtttctattacaagtacatatttcaaaaacactacttcatggaaattagcatttgaacttacatgctcaatatttatctaaataaacgttgcacgccatccaggctagtaacaaatgaattcatatttagcaagattaataaaaagaacaaagttactttgagaaaaaaaaaagcagcctaataagaacttaatgtctacatttgagaaaaagcagcttaataagaacttagcgtgtacattttaggaaaaaagcatcttaatatgaacttaatatgtacatcaagtgctcttttacatttattagtagataagataaagttacaatattttttactaataaaattatataatcctgcacaaaaaaatcaatgctgttgatcaattcttcaaacatagagaagtcacatttactaagttaaatacagaacttatactatgccgtgaattattagatgaatacgaaacattaactgaaatactataaaatgactacgtttattacttctgaaaaagaggaaagaaaatgttgtttcccacgttataaaccaacaaaaaatgttaaaccataaagtacatcataagaaagcttattaagtgcaaatgctaaatgcagatgaagctcaactataaaatattaatgtaccaatatcagaagataatcagtattattacttactggccttctcagaagataagttagtgttttacttcttcatctttagtatgtgtagaaggtataaatgtccaacattataggcaaaaaatattgtagtatttcaataccaaaattaatatttattaagatataatttaatattaaaaattattaaaaatatttattgtaatatagttaattttatttattatttaaataaaataaattaattaaatattatgcaaagtttagatattaaaaaatttgttaatggacatttatgcagaaaagcagatgccctctcttttatttatcaaaaatgttactgtataggtcataccccagaagacagtgatacattaacaatacatctttccaaaacccataaaagcaaaaaaaaagtggtgccatctaagaattccttatttgtattaaatgttgaatatcctgttgcgatgatgaaacaattgcgacatatgaattttctaacattatcaaaagatgaaatgggaaaaaatgttatagatgcaaaactttatatttttgtcaaacaatgtaatcttaaaaaattcatgaaagaagtattaaataacaataaaccaggatctactgtaacaccatctgaatatggtagcgttgtctatacagtattatgtaataataagctttttgaagattttaatgaacataatgctttaagcacaatttcaaagatggcattaacaaatacacgagaatttcctgcttttaagtttatacctaaagttggtatcgcccggaaattactacatgctataggatgtgtttcacaaaatgatgaacctttaacctcaacaacaattggcactcaagaagaagaatcagtacctacattagattgtctatcaacagaaccaatttatgagcctttacaaacacataataaataatatatcatacacattttataatatattaaatgtacatataccattctttaattttccttaaataatagtattattacagatttattataaaatttattataaaaacgtgttttttaacggtaaatcatatgcttaattttagtgaagaagaccatcgacagtacaacaatgtattatgcagaaacctgaagtctatgaatgttactgtactaaatggttattgtgtcggtactacacaaccaaataataagttggaagtatctactgaagctgatgaaataaaccctattgtaccttcacaaggaggtccatctttgtttaagctcttcgttcagatcccaaaagattccgtattaggtgatccaatactcacggagagtgttgatttctcacaagaaaatattaccaaacttactgttgaagcagaggtatttgctatagtacgttcaaatgatacaaaacattttgtgcatatattagacaaaaccaatgaagaaaaacgcaaacaagataagaaaaagagtaagaaatataaagctctggattttgcatctattgctaattcctgtaatcctgtacttgtaaaaccaaaagcatatgctaatccagaagtcaagtttgacttaaaatatgcattgttaactactggtggactaaattatgtaacattctctccaagcacaccaagaacagaagaaagattaaaaatattatcaacatcagcaccttcaatattacaacaacaacctacatcaagactatcagaaagtgatgtagaaggatcagcaggctgcttttctttcttaagatgtacacgttaaattcctaataggatgcttttttttagatgtatacattaaattcctaataggatgcttttttcttagatgtgcacattaaattcctaataggatgcttttttcttagatgtgcacattaaattcctaataggatgcttttttcttagatgcacacatttaaattcctattagtttttttctttcttaagatatgtacattaaactccactaagctgcttttcttagatgtacatgttaaatttttatttagtaaaaaaataatatccaattataaatagaaatttaataatatataatcctctttattttcttataaaaattgataaagtgcattgtataagaaatttaaatgacaaaatggaaaattaagtataccaggagtgatgacactactattctaactaaaagtgaatataacttagcattatatattcaacaatcaaaaatctttcaccaatacttaaaagacagctaaacaataggaaaaaatgcaaagctttaacagtaaagatcaacttgaaaattttattataaaacacaaaacaaaagaaagcaacaattataagtcttatgcattttgtatcgttaataggaatactatatttgaattaagaaaagaatttatagagatttgaaaatttagatatttattttacctacaaatataattgaaatctatgaatccaccttatcaaaacttaatctaagaacaattattagtacttaacaatcaataatattagaatatgttaacccataaaatacataaaattataaaaaacaaacaattaaaaaaatcactaataaaattaattatcatataacaaaagattgtttttttatatcttataataaaaaataatacctttatatcatataattattatgatttttcataaagattaaatattgtagaatgttatgttaggtatattaggaaataatcttgaagaacaaacttggtataatgagaaattatgtgcagatgtatcaaagatatcaaaaacagaacctcttatatgttatcgaagttattgcataggcaataccgaagatggtgatactaaacaactacaaatttttgttaatgatagttataaaaaaaatgtacataagtgtttcccaagtgggaagtccatgtttatattaaaaactttattaccaaaacatctaataaagcatcatagcaaaatacgtcaggcagttatgaaatatacacaggattatgatcctagtttctgtcatatgcacatatatcttttggtaaatgaagataagctcaatatattttaccatgatgtacataataggttattaaataaagaacgactgatgatacctattgaagatcttactcaatatggcacaatggaattaatttatataccatatataaatcgaaaggaaaaaaagtttgatatggagtacgctctacaaaatgtcgcaggattaaatgcacaattcatatatgatcaacaagaaaagaaatcctctgaacatgatgaaacaaatgcaggtgctgtcagtagttttttttccaatttgagaataactattactaaaaaagcatctactgatgaggataaagaacctttagtagcgaatacaagaatgtagcatagaaagtataaaaatttccttgtgatacactattttttaatctaagctagctgcatatcaaataaaattaaaaagataaatgggaaaaaattgctaacacacttagcattttttcccatttatctattgttttgatattttcaggagttgttgaacatgctataaatgatctattacctgctagtagtcagcagcaataggttcaatataataatttactatcttatagtgctggtttttcactaaaatataataataatattgcttttataggatcgtatagcaatcttggtaattttggtaaaaaggaaatttctgtacaatctaatcactataaaataattgatagtgaattttatgatttaggtttaaagaattattcaagtagaatcatagataaaaattaacaagaaagtatatcacaaaatttttagatttctataacctaaaaaacataaattataacaatgtttttaaacagcaaaaaacaccattccaaacttacaaaaacataatacctatgtttgtttatactaagaaacttaattttagtttttttcatcaagaagaaaactagtatatatgcaagaactagaaatatactcgaataaaaatataattaatctgatactacagcttcttttttttgtatttccatcaatatatcctttaccttatcaggagttaatttctcataataatcatcattgatctgcataacaggagcattaacacaagcccctaaacactctacttctttcaaagtgaataaattatcactcgttgtttctccaacacatatattaagcaattccttacacgattttaaaatatcatcactaccacacaaccaacaaggagttgtcctacacacttgtattaaatatttaccagtaggagataaattatacatagaataaaattttgctacctcatatacatgtattagccgcatacccaaaaaatctgctatataattcatagcagacaatggaataaatccaccacactgcttctgagcaatatgcaataaatccattacagcactcgattttctatcatgaggatacttactaattgtatcatttgcttgttttaagttatccttattaaatttaaatgtttcagtataatgttcattactatttttctgtatattagacattactcattacctatctatttctccaaatactatatctaaagacccaattatggctgttaaatcagctaacatatgaccttttgccatcatatctatagcttgcaaatgagcaaatccaggagctctaatcctacacctatatggtttatttgttccatcagatactatgtatacaccaaattcaccttttggagcttcaacagccatataagtttctcctattggaacactataaccctctgaatataatttaaaatgatgtattaacgcttccatagattctttcatttccgacctttttggtggagcaatttttctatcatctgtttttattggaccatttggaagacgattcaagcattgttcaagcaacttaattgattgcctaatctctgccatccttactagataacgatcataacaatctcctttttttccaataggaatttcaaattctaaatcttcatatatttcataaggttgacttttacgtaaatcccaaggaataccacaagcccttaacattggaccagaaaaaccccaatctaatgcctgttcttttgatacaataccaatatcaacattacgttgtttccaaatcctattttcagttaacaactcatctacatcatctataaacttagggaaagttttaataaatttaaatatatcatcaatcaaatcatctggaacatcagctgctacacctccaggacgaatataagcagaatgaaacctcgcacctgatgctctttcataaaaacctaaaatcttctctctttcttcaaacatccatagtaaaggtgtcatagcacctatatctagcgcttggcttgatatatttaacaaatgattcaatattctagttaactcacaaaaaataacacgtaaatatttagctctaattggtatttcacattttaataacttctccacacataaagaataagcatgctcttgacacattggagatacataatcaagacggtcaaaatatggtaaagcttgtaaatatgttttatattctattaatttttctgttcctctatgcaataacccaatatgtggatctatcctttctataacttcaccacccatttctaaaaccaaacgcattacaccatgagctgcgggatgttgaggaccaaaatttaaagtcattggtgtaattttgactcgatcagacattaccaaattaccaagaatataactataaattatgtaagtacatatatcacatgtcaagaacaagcttctatatagcataaagagaaattcttatttaacagatataaacacgacacttataacaaaatgtattaataaaaaactaccttagtatgaaaaaataaatgaagtaaacacattaaaatatcatcttccaataaagtctatttatgcatagcatgtgatacatattgcttattattactaggcaatgaatctgtatatactagaatactcgaaactaatactacccatagcaaagatataggtaaaaatactttccatcctaaccccattagctgatcataacggtacctagggatagtagcacgaatccatataaagcaaaataacaatgctaccactttcaatacaaaccatacaatcccaggaattatatataagaagccaatatttaaaggtggataccacccaccaaagaaaaatattactgccattgcattaattaatatcatatttgcatattctcctaaaaaaaacaatgcaaatggcatagatgagtattcaacattatatccagatactaactctgattctgcttctggtagatcgaaaggatgtctattagtctcagctaaagctgaaataaaaaaaatacatgccattggcaataataataaatctatccagtaaggcatattatgccgtgctacaactatctcacctaattttaatgatccagttgctaataacactgtaactatagttaaacctatagatacttcatatgatatcatttgtgatgcagacctaattgcacctaaaaaagcataatttgagttacttgaccatccagctattataattccataaactccaagagaagaaatagctaaaatatatagtacaccaatatttatatttgcaatagcattaggtattatcacttcatatccatcattaacaattacatcagctccaaatggaatgacagcccaccctaacaaagctaaagtaaaagtaataatcggagcaatcaaaaaacatattttatttgatttaaaaggaataatatgttccttaataataagctttacagcgtcagcaaaaggttgcaataaaccaaatggtccaacaacattaggaccttgcctcaactgtattgccgcaataaccttacgctccatgtacactaaataagcaacagatatcataaccgatattatcactgcaattatttttataaataatgcagctccactacctatgtaacttaaaaaatccaaaaaaatattataataactcatactcacctaatctttatttgcaaaagcttttacacaatttgccattataatagatgcacgactaattggatttgccatataaaaattaaaatctttattaataaatacactatccctttctaaaatcatacttccatcaattgaagcccatttattagaaattaagcttccaatattttcttcacgaaattgctttcctaatgttgacaatttatttctaatgcaatttaaactttcgtattgcatatccatttttaaatattttgataattctttaataattaaccaatcttctcttgcaagaccaggaggagaaacagcaatatttgttctctgtactctaccttcagtattaacataagtcgcatttttttcagtatatgctgcaccaggtaatatcacatctgcaacctgtgctcccctatctccatgatgtccttgatatataatgaaagaagacttagaacgagaaatttctacttcatctgcacctaacaaatataaaacctctatttcactagaacctataccattaattatatcagacattatattagtgttagaactaggaacaaacccaatatctaaagcacctactctagcagaagctttatgcaaaacattaaatccattccaatcatctcttaacataccaaattttgctgcaattttagtagctaatacaaatatagaatgaccattatcaccaaccaaagcatcttgtcctattattaacataggattttttgcatattttaacagttcagaaaaaggtattttttcatgtagaatatcatctaataccaaacaactattccctaaatcttctactttataattaaaattatcatagacacctaaattagcaatcttaaatcctcctcgtaaataccttttacgcaatcttgcattaattataggcgcttcaaaccttatatttgtgttgattaataaacacaaatccgcattttctatattagatataccagtattaaacaaatataaagctctgctattagtaggtactactgatccatcttgcctacattctatattagaactccctaacccatgcattagttcctttaatagcaacatagattcacaatctgctaaatctccagcaattgccgcaattttatctccagaaacattactaatccttttagcaattacattaaatgcttcttcccatgttgcaggtaataactgcccattctttctcacatatggtttatccaacctctgcaattttaaaccatcatacgaaaaacgtgttttatctgatatccattcttcatttatactttcattcaatctaggcaatatcctcattacctctagaccacgtgtatcaaccctaatattactacatacagcatctaatacatctattgtttcacaatgacgtaattcccaagatctagctttaaatgcataaggttttgaagttaatgcaccaactggacaaagatctattatattaccagataattctgaagtaatacatttagaaatatacgtatctatctccatattttcaccacggcccattgtacctaattcatagctaccagcaacatctgataaaaatctaacacatctagtacaatgtatacatctagtcattgtattttctatcagtggaccaaaattcttcttctttacagctcgtttctcttccttatatctgcttttacctctaccatataacatggtttggtcttgtaaatcacattctccaccttgatcacaaattggacaatctaaaggatgattaattaataaaaattccagtaccccttccctagctttttttattttgtcagtattagtctttactaccataccctctgcaacaggcattgcacaagaagctacaggtttaggtggaccaccaacaacttccactagacacatcctgcaattacctgctatagcaagcctttcatgataacaaaacctaggtatctgtactccagcaacttcacaagcctgcagtacagtcattccatcttcgacttctatttctaaagaatctataactagtttaaccacgcactatccttatatactagcccattctataggattacctgtagtatcttgtactaaatcaccattatcatattgacctgcaataaaaattttacctgcttctctattaatatatttaactggctttacagatttaccattatacattttttgagctgtaccttttttacgttgcaatggattattcttacttgctgtttttgcaactttagctcctttcttagccataatacccccatagccataaaatcatgaagtaatagcacattttaccatttaggtttttaacgtcaataaattatatagacaaaactcttaatgatttgctatttttactttaattctttatctttacaaaaatatctttaatggaggtaatttattaataaaacatattcaacaatatttactacttgttattacgcatcaatattttgtacatttaaagcattattattaataaagtcacgtcttggttctacaaaatcacccataagcactgaaaatattgaatcagcagcttcacaatcagctattttaatttttaggagtgtccttgtttcaggatttaatgtggtatcccacaattgatctgcattcatttcacctaaacctttaaacctctgtaaggtcatatcctttttaccaaattcaataatattatctactaaagaagtaggtgaacttatttttatattattgtctttagtagataaaataggcatattataaaaaatatcctcaattccatcacacatagcaataacatgcttaatatcttctgaattcatcattgcgctattaatataatatttatcaaccagcccatgagataatctaaaaatacttatctcatcttctttaggtatttcaacactccattcatattcacaaaaaactttatttaaatgatcagatattgcaccagcagaatcaaaattatgctttctaaagaaaataatcaatgattctaaaacatgctgaggaattaccctatcataagattttgttatcttactaatattcatacattgatgtaaaaccttagataaactatttcctgaatagctttcacctgcattaagagtgagatcttttactgcattattaattatataatcatgcaacatatcatcattttttatataaaattctttcttatgttttgtaaccttataaagtggaggctgtgcaatatataaataccctttttctatcacttcacgcatataacggaaaaagaatgttaacaataaagttctaatgtgtgacccatcaacatctgcatctgtcataataataactttatgataacgcactttttcaatatcaaaattttcagttccaatattactacctattgcagtaattaatgatgctatttctgctgatgataatatacgatctaaacttgcacgttctacatttaatatctttcccttcaaagataacacagcttgagaacgtctatcacgcccttgctttgcagaaccacctgcagaattaccctctacaataaataattcagataactctggagacttttcctgacagtctgccaatttacctggtaaaatagtaaagtcaaaaccgttcttactttttatcaaatctcttgctctacgagcagcttctctccctttagcagatctaattattctttctataatgctagtagccaacttaggattagtttcaaaaatatttgtaagcttttcatacactatattttctacagctgtccttgcttcagaacttaccaatttatctttagtctgagatgaaaatttaggatcaggcaattttattgccaatacacaagttaaaccttcccttacatcttctcctaaaatatttacttttgccttttttaagaaaccctcatttgttgcataattattaatacaacgtgtcatagctgatctgaaccctgcaagatgagtaccaccatccttctgcctaatattatttgtaaagcataacatattctcatagtaagaatcattccaatgcattgagagttctaagctaatcccatgttcaagcacaattccctctatatgaacaactttggttacagcagttttattgcgatcaagatattttacaaaagcagcagttcctctatcctctatatcattaactttagaattatccttcaaaccaaaagatgaatttaatatttgagcaccccttaaatcctttaggttcatattaatatttgaattaaggaaggacagctctctaatacgattctctaacgttgaataactaaaatttatagatgaaaaaatattcttagatggtaaaaaagtaattttagtacccttcttagttgtattctcaccaaccacagataacgatttcacagttatcccatcttcaaaacgcataaaatactctttaccattacgccatatggtcaactctaaccaactagaaagagcattcacaactgatataccaacaccatgaagtccacctgaaaccttataactattgtggtcaaatttaccaccagcatgtagctgtgtcataattacttcagcagctgacatgccttcgtcctcatgcatatctacaggtatacctctaccattatccacaacagaaacagacccatcactttgaattacaatatctattttattgcaaaatccagcaagcgcttcatctatagaattatcaataacctcatataccatgtggtgtaatccagatccatcatcagtatcaccaatatacatgcctggtctttttctaaccgcatcaagtccttttaagacagtaatcgaactcgcattataatcatccatagcaacattataagttaattaagttaatagacattatatctgcagaaaattttagataaagtaaaaaaagtctttatttataagttcagtgcattattatcaagcgtataacttgatatacaatgtgcattaattaatattattaattaatacataacgatataccagtaaatttaggttataaaaacttaattctaactacattctataatcaaagctaccatgtaaccagccaatacatactatttttataaatagaattcagattgtaaaaaaatttcattcaatgtttaaataatatgtataatcttaattaataacacttttacatataaaataggagtataatgaagacactattagaggtaagtaatctaacatctgatgacatagaatctatttttaaccttacaatacagtactttaataatacaaacttaaaccataatatcctaactggaaaagtcattgttaacctattttttgaaagctcaacacgtactttatcttcttttgaaattgcagaaaaatcactaggtgcacattctattactttaaacattaacacatcatctataaataaaggagaaagcattatagacactatttcaaatatagatgcaatgaatcctgatttaattatcataaggtcgcaatacagtcaatttatcaaaaaaatatcagaatatctaccaagctgttctataataaatgccggagatggacatcatgaacacccaacacaagcattaacagattactgtactatacgttacataaaaaaagatattaataatttaaatatatctatatgtggagatatattacacagtagagtcgcaagatcaaatataagattattatccagatatggagctaatatatctttagttgctcccccaacattatcatgtaacttaacaggtatatcacatatatatcacaacttaattgaaggaatacgcaatgcagatgtcatcatgttgctaaggctacaaaaagaacgcattattaattgtgttattccttcagaacaagaatactctcacctatatatgctaaaccatgaaaaactattacatgcaaaaaaagacgtcatagttatgcatccaggacctacaaataaagggatagaaatctccaataacgtggcagaaaaaaattctgtaattctattacaagtaaaaatgggtgttgcagcacgtaaagctatattacattatttactgtacaataagtcaatataacatcaataatgcgatataaaattactatagaatataatggatctaattttattggatggcaaaaacaaaaacactcatcaaattccattcaagaaattcttgaaaatgcaatactcaaattttcacaacaacatactacagtatatgttgcgggaaggactgatgctggtgtacatgctttaggtcaagtagcacattttgatttaacaacaaaccttgacacatatgtagtaagaaatgcaataaattatcacttaatacctcatgcaattgccatattaagtgtagaaaaaacagatgataaatttcatgcaagattttcagcaaaaaaacgtcactatttatacaaaataataaatcgttattcaccattaacaatagattataatcgtgcgtggcttatacataatcctttaaatattgaaaatatgatacaagctatcgaatatataaaaggtaatcatgatttctctagtttcagagcaaggcattgtcaatccaaaaatccaataaaaacaatagatgatttaaaaattattcataataatcaatctattaacattcatatttctgctatatcatttttacatcatcaagtacgtattattgtaggtacactagttgagtgtggaaaaaataatttttcaccagaacatataaaaaatatcttaaaagcaaaaaatagatcttatgcaggtatgacagcaccaccatacggcttatattttgtaaaagtagattattaaagttttatacagtacaaaacgtactttcgataaataaaaattcactaataatgcttaagtaaataacagtataaatacatatggttaaacagcatatctaatgtaataccaaaaatatttttatgaaatttacttatagcttttacataaaaaataataggataaatacaaatatttaaaataaatacttaataagatagtatattaacaataataaatatctggcatttttatggattttccaaaacctgttcctacagctttcacataagcttcctttgctgcgaaacgttttgcaaagtgtcttacttgtgcatcaaaatttgtatatttcttactatcttctatttctttttcactaaatacccgtttaagaaatttagtaccaaattttttccataaatttgatatacgaggaacataaacaatgtctgcaccaatccctagtatcatttttttaatttatttaagaattgttctgtggaaattaaaactttatcttttgttaatctattccttacttcaataaggtcttgttctactgttgatttaccaattataacttgccatggcatacctagcagatctgttcttgctaacttaataccaggactatcatcaacttaattacataactataaaaaccattttattacataacatcaaactagctttgcacttaaaagtacaaactaagattaaaaataaaacctattaatagaatttattattccatacatacaaatatttattccttacaacatactatgagctatacaaaagatttgtaatacaatcttctcacagttatttttattcacaccatttaaacactaaagcaaacgtttttctagggtttagaaattagcttatataatgcttgaaatcttacaataccattttaaatacaactttaaatttttctagacacatagtctttgctaaaacaacattatccataaattaatcatgaatacagaaataaaatataaaattagcaaattctattttacttgcttaacttactattgtaatttattgctaaattgacgaagtaagctatcatgtataccagtaactggtgtattcttttttagcaattttactaaactctttctatccaccttaatgttttgtatatccgttaccttattagcttgagaatcaaaagttatttttaaaacaagagattcatattcttttgttgaaaaaaaacgcttcttataaatactataagaaacataataccatacattttcctcaataatgcacggatcccctataagttgtataacctgactacttaaatccccaacctttacattattccacaaattaacttctgaagcaggatagccatggtgaatagatatagtatgacaactacttaataaaaacaaagctatataaataactctcgttagcataacatctcaaaaataagtatcgtgtaaagttatcataatttaattaactggtcaatttcatattatatatttttaaatatatacctattagtaaatacaaaaacattattctacaaaatagatgcttacagttcacctttccaatgcttgatttattaggtctatagtattatttactccatataattttacaaaagatccaagcctagggccatgactttgccctaatagaatttcataaaaactttgaaaacaagatcgcagatcattaaaacaatattttttcattaaagaaaatatattactttgtatttcttcagatgtaatattttctgagaaatcattaagcatatttttcaattcatctaatatgattctttcatcatgatttggagttttataaaccttatatggttttacaaaatcatgataatatttaactgaaaaatctactaattgagataatattttattatcttgtagattatcattatcttggtaattttcaatgaatccccataatacttcactagtttcagcattacaagcagatgctaaattcaataataaagaaaaacttaacccagaaatattaattaatggcacatttccattatgaatatgccacacaggattatcacaactaacatttttatgataatcatccactagacataaataatcatccatagaacgcggtataacatcaaaatataacttctttgcctttttaggattctgtaatatatataatgctaaactttcagaaggagcataagacaaccaatcttctattgatataccattaccttttgattttgaaattttcctaccttctttatcaagaaacaactcataacagaatagaaccggaggttcactacctagaatctcacatattttactagataattccgcagatggctgcaaatctttaccatatgcttcatactttacattaagtgctgaccatctcataccccaatctggcttccattgtaatttacattttccacctgtaactggaacttgaataacttccccattctcatcctgataagaaatagtacctaatgcaatatcaatatcaacaataggcacttgtaatactcttgacgttctaggacatattggcaaaaatgggctataagttttttgtctttcactacctaatgtaggcagcataacatccatcactttatcataatttttcaacaataagagcaacttttcatcatataaaccattcttataacattctgttgcacttttaaattcatattcaaaattaaataaatcaagaaacctacacaacaacatgttcatatgatgcccgtaactttcacaagcacaaaaaggatccggtatcatagtcaaaggtttacctaaatggtcagctatcatatctttatttggaatattatctggcactttccttagaccatccatatcatctgatacaactattacttttgttgtaatattaggacagattttacgtagagcattcattattgctgtagtacgtaatacttctccaaaagtaccaatatgaggaagtcctgacgggccataaccagtttcaaaaataatttctgtattctccccaaatctttttaatattttttctgcttcttgaaatggccaaaatttgtactgtcccaccataatacataaaactgatagcttataatctcactcacctatataacacaaaatgtataaagtggcaaatatatagcaagattacacaaaatgaatttcgaaataccctataaactattttaaaatagtatcaaaaaatcttttctagaacataactataacttttatttagtattcctaaatcaagcagataattgagataccgcagcttcatcaaaaatgctaccccggtcacctttaagacaacaagaccttataccaatatgtcatggtcatacaacaaattaaagggttttaacatttataggaaattactccaaactatactggatcatcatgcataacaacacgacgttgctttattttcttatgcataacccccttcttacgactatctacagattcagataagcgaaattttatataattatcaacaatctcattaaacttatccatatgatcacggaagaaatgatctgctttttctataacataatattgcatgtactcacttttaatagaattactcaatcgagcagctagttgagatactgcagcttcatcagaaatgctatcctggtcaccttgaataattaatccaggtacaggacaaggtgataaaaatgaaaaatcatatttattcgcaggtggtgacactgctatgaatccttcaacttcaggacgtctcatcattaattgcatagcaacccatgctccaaaagaaaaaccagcaacccaaaaaggagatgatgccatattattattttgtaaccaatctgctgctgctgcaccatcacttaactcacctatgcctttttcaaaattaccagatgatttacctactccacgaaaattaatccttaaaacagaaaatccattattagcaaatatattgtataaattatatacaatcttattatccatgtttccaccatattggggatgaggatgaaaaattaaagcaagtggagcacctaacgttttgttatgatgatatttcccttcaattttaccaactgcaccattaaaaaatatctctctcatgaattaacttccttaaataaaaaatgagcaaactactatccaagtgtataacaataagaaaaaaaactcaactttacaaaagtatttttataataattataagaaataagaaaattcagatacatattttaatttatattatcatatacaaaaacttattttaataataagactaatatattaatcttagtatttagattagcaaaaacctacttgacataaggtatattaatgatacattaacagattgttgattgtaataaaaatctttcataaaaatatttcaacaaaatcgaatgattataaagatttggaaaatttaatatgttaattacgacaaggctacgttatgctgtcatgtttatggtaaaattagctcaggagtattacacattaaaaggtagcactcagccaaaaaggatgtcacatattgcaaatagccaatccctctctgaaggatacttagagcaaattattgtaaaactaaaaaagcaaggattaataaactctacaaaaggccctggtggtggttattctttaaataagagtccaaattcaattacacttaatctaattcttgaatccataggagaaaatataaaaattacaagatgtaaaaatcatctcataggatgcttatcaaataatgctagatgtattactcacaatttatgggataatataggcaatcatattaaaaaatatttaaatagcatttcattagaagatatacttaacaataattttaaatctggcacgactgtaaacaataatgctaatgaatatatatatgcagattataattcaacatcaactatattacccacagttaaaagtcaattagataatctatcttctctaaacatatacaatccgtcatcaacacataaactagggcaaaatacaaaaagtattatagaaaaaacaagagaaatagccatcaatcaattaaatgctaaaaatcatgacgtaatttttacttcatctggtacagaagcaaacaatttagtaataaatagtactgctgattataaatacttaatttcttccatagaacatctatctatcatgaactgtgcaataaatgcagaattaataccagtagattctaatggaacggtatgcttagatacattaagcgatattttatacaaatgtaaagatgaaaaagttctcgtatcaataatgactgcaaataatgaaactggagtaattcaacctataaaagaaatagtagaaatatcacataaatttggtgcaatagtacatacagatgctatacaagcatgcggaaaaattcacgtagatattgaagatttaggggtagatttactaacaatttcatcacataaacttggtagtattgctggaactggtatattgttttttaatagtaaaaaaataaaaataaagcctatgatattaggtggacaccaagaaaaaggactacgtgcaggtactgaaaatgttgtatcaatctatttattatctatatctctaagcaatctaaaagattctataaaaaaaatgtctagtgttgagagattacgtgataaactagaaaatcaaatattaaacttggtacctgaagctcaaatttttggcaagaacacacgaaggttaccaaacactacatgcatttcgatgccaaatgtaaacagtgaaatacaaacaataagttttgatattgataacattgcagttggtagtggatctgcctgttcttctggagcattagaacattcccatgtattagctgcgatgggaatagatgataacgtagctaaaaactctatcaggattagtcttagtcctgatgtaacagatgatcaagtaaacaaaatagttaattgttggtacaagatatataaaaataatcaattactcaaattaaattaggtagaagtgatgaaaaaattagaagattattatattatgagtagtaggtcataagatggaacaagaaaaacgacaaatcaatttacctgtgtttctcgactatcaatctacaacaaaaacagatgatagggtattagaagctatgatgccctactttaaacaattttctaatcctcactcacgcagtcactcctttggctggaaagctgaatcagcagttgagttagccagggaaagagtcgcatctttaataaatgccgaagctaaagaagtaatattcacttcaggtgcaacagaatcaaataacttagcaattaaaggagtagcaaacttttataaaaacaaaggaaatcatataattacagtacgtacagaacataaatgcgttttagattcatgccgttacttagagacagaagggtttcatgttacttacttagacgtacaaaaaaacggtatcttagatttagagttattaaaatcatctatcactgataaaacaatactagtatcagtaatgatggtgaacaatgaaattggcgttattcaaccaattgaaaaaataggaaaaatttgtcatgaacatggaatattttttcatactgatgcagctcaagcttttggaaaaatatcaatagatgtcaaaaaaatgaacatcgatcttttaagtatatcaggacacaagatatatgctccaatgggaataggagcactatatatacgcaaacgccaaccacgagtacgccttactcctatgattaacggaggtggtcaagagcgtggtatgagatcaggaacagtacctactccattagctgtagggttaggagaagcagcacgtatagctcaagaagtaatggaggaagaaaacatcaggataagagaattgcgagacattttatataatgaaataaaaaaacacttaccatatgtcgtattaaacggggattacgaacaacgtatagcaggaaatctaaatttaagttttccatatgttgaaggagaatctataattatggcaatcaataatctcgcagtcagttcaggttctgcttgtacttctgcttctttagaaccatcctatgttttacgtgctttaaatattgaaaaagacttagagcattcatccatcagatttggtataggtaggtttactacaagagaagaaattttatatgccgcagagcttattgttagcagcataaaaaaattacgtgagatgagtccattatgggaaatggtccaagaaggtgtagaccttaataatatcaaatgggatgcacattgattatgttattatattgtcgtaattatgaggtaattttatgagttatagtgaatctcttctagagcattacaaaaatcctaaaaacgtcggtactctacctaaagaagattataatgtaggaactggactagtaggagctccaagctgtggagatgtaatgaagttacaaataaaagtagatgataatggtaaaatcattgatgcaaagtttaaaactttcggatgtggagccgcaattgcagcaagttctttagcaacagagctaataaaaggtaagacaatagatgaagcacatcaattaaaaaatactgttttagcaaaagaattaagcctgcctccagtaaagatacattgttctttacttgcagaagatgctgtaaaagctgccataaaggattataacatgaagcaagcaaccaaaaaagacaagctttcatcttcaaatgaatagatatctattaaagtaaggtttacatatgatgaatagtgaaactcctacattttataatagtgaagacagtgaagataattcatgcagttcacagatcaagtatcacataaatagcaaaataacaaacaaatctcccattattattacagaaagtgctataaaaaaaataagagagcttattaaacaaaaagaaggtgctgttattggtatcaggattatggtgaaacaaaaaggatgttttggtctcaagtataatattgaatatgcacatgatatcaagctattagatgtagaaattaaagtagaatatcaaaatgagaattttactatattaattgaccccaaagcaatgatgtttatcaatggaacagaaatggaccatgtagaaaacaaaatatcttcaggttttacatttaataatcctaatgagaaaggaagatgtggatgtggggagagtttctatgtataaagactatttttcattattcaagttaaaaccacaattctctataaacatgcaaacattagaacagaattacatagcattacaaagcaattaccatccagatttattctctttaaaattagagaaaaaattggcattagatactataacagaaataaacaaagcatatcaaactttaaaatcttctataaaaagagcagaatacttattagaaatcaagggaattactactaataaaaatgatattaatatactagaagaaatatttaacatacaagaatcaaacagcattgatcttcaaaatcaaattttattatccactaaagctatggaaaatgctttttctgtagaagattttaacgaagccgcaaaacaggtagtaagattaaaatatcttaaaaaaattcaagaggataggagtattacttcatgcaattagtaaacataacagaaccagaaactagtgaaaaagtattagcatttggaatagatttaggaactactaattctttaatttctatgattgatagtgaaggcaaaatcatcatattttccgatgaagatggcaaattccttatttcctcaacagtaagctacattaacaatcaaatacaagtaggaaaaaaatattccaataaagctatctgttcagtaaaaagattaatgggaaaatcaatcaaagatataaaaaaattatctttagatttaccatttcatataattgataaaggtgataataacatatacatagataagcaagatggtacatatgttacaccagttgaagtatcagcagaaattctcaaaaaattatgtaaaattgtaaaagatagtactaatctagaagtaaaaaaagtagttataacagtacctgcatattttgacgaaacagctagaaaagcaacaaaagatgcagcacatcttgctaatcttgaagtattacgtcttttaaatgaacctactgcagcagcattagcatatggtactgaaaaaccagaatgtgagaacaatatctatatgatatacgatttaggaggtggaacatttgacgtttcaatactgaaattacaccatggagtgtttcaagtattagcaactggtggtaacacaaacttaggaggcgatgatatagattatctacttgcaaaattgatatataacaaatatcaacaaacagaaaatgttaatgatacaccattaaataaagaattgctaaatgatttaattgcagatgcaaaatatgcaaaagaatacctaagtgaacattatactggaagttttacttttaaaatccatgacaaaaatttttcttgtgaactcagtagagatgaattagaaagtataatatcagatttattaaatcaaactttaagtattgtaatttcaacaatcaatagtatagaactgaattttagcaatattgaaaaagtaatattagtaggtggatctactaaaatgcctataatcaaaaagatgctaaacaatatattccacaataaagtattttgcgatgtagatcccgacaaaatagtagcagttggagctgcactacaggctcattatttatccaacccacaaataacaaacaaaaatgttttaatagacgccttaccactttcactaggtatagaaacaattggtggtattgtagaaaaaatcattcccagaaatacacctatacctgcatctgctacacaagaatttactacttacgttgatggacaaaactccatacaaatacatgtttgtcaaggagaacgagaaatggtagaacacaataaatcattagcaaaatttgatctaaaaggaataccaccattacctgcaggtactgcaaaaattatagtagaatttaaagtagatatggatgggttactaactgtttcagcacaagaaaaatctacaggaataacacaatctatcagcataaatcacacatgtgaattagatcaaaaagaaatagaaaataacattatcgattctataactaattttgaacatgatatgcatatacgctcaatagctgaacaaaaagtagaaggacaaagaatcattacacttattaaaaatgcattaattgaagataaaaatttaatatcagaattagagttcaatacaattaataatgcaatcgcagaagctgaagaaatattactgaatggtaagactgatagaattaaagatgtcataaacaacgtagaaacacaagcacataattttataaaaaaaagaatggatttttatctaaaaaaatccattgataactgtaatattaataattaatacatggaggtatgttgtgccattaataacattcatttcacctgatggaagccgaaaaacttatgaagcttatgatggagaaaccttattaagtttagcacatagaaataatgtagatttagaaggtgcatgtgaaggttctttagcatgttcaacttgtcatgtaataattgatccaagttggtatgatatagttgaacaacataatgaaatctctgatgaagaaaatgatatgcttgatttagcatttggattaacagacacttcacgtcttggatgtcagatcattctcacaaaagaacttgatggattatgtgtaattttacctactgaaacccgtaatatatcttttgtaaaaaatagttaaccagttataaaataatgaagtattttaataaaaaactaattgtaatatcatcaattgttattgcatcaatttcgtctttatacataggtgtttggctcgttattgccactcatgtcaaagcaactttatcaaaatctttagcatatatccatgcagagcatagtaatgatatacaaattacgaacttcccctttattccaaaaataaaggtattaaacttaaaaataaattcatcttcattaaatatatccattccatcattgtcattaaaataccatttattaagcaatacattagaatttataggtttagataatgctacactaacatttgaaaattcaatgaagatcacaaacaacgaccagaaaaatacttcagtttgtaatctacatgataacttcaagttattaattaaaccttctaaaaatttattactttttttattagataataaaaacgataagaaagcatatttcacatccatggtatatgaagacaatggtataagttgcaataataatcacattataaataaaagcatattttctgtagaaactgatgaacacaaatctttcgataacctgataacagtactacaatacaaaatcaatgcaagtgctgctagtaatacagatactaacatcaatgtaaaaataaaagatgctatagtaacgttaagtatgtcaaataccgaattcaaagagattagtgctataatagataatatagcattaacatccaggaattcattaatttcaatttatggtaagctattactgccattatctctagatacgcaaattaatgatgaaaaattaattatagaaataagtaattatcaggatatcattaagcaattagtaaaaatattatatcctaaatcacaacataaagataaaatattttctgctctacaagattatatatacgcaatttccgaaaaaaaagataatggtaatattatattatcggtaagtgagacagttaatccttttaatatttttatttgcaaagttccttatgaggaatttattagtaaaataaaagctattacaaacactatggataaccatgcaaataaaaagtaattcagtatttattactatattagcattctcgtttttttccgttttttctgcctactctttttcaatagatgagaaattagtcaataatgaaatggaattacgtgcaattgatctatttaaaatagtaaggtgcttaatttgttctggtgaatctatttatgaatcacaatcacaattagcttatgacatgcgcttaatgatacgcaataaaatcaaaaatggctacaatgacaaccaaataattactgaattacgaaattattatggaaatcaaataactatcctacctccttacaatccatatacttatccattatggatattacctattcttatttttggaataggaataattataataataaaatttatttattataaaatataggataattcaaatagttatagttaattattaatttatcatattaaaactaataatattaaaacctatctgctggctaactagccataccgcactaaatgtaaaattaaaataatcctaactacttaccttttgtgcagctaaaatataatttacagaaatatcatcggataatacccaacttctccttatcatattaaaattcattcccataatgtttttgacacatataccattaagtgaaaacaaatttacgatttctgaaggcttaacaaatctaccccattgatgtgtcttacgcggaaccaattttaaaatatattcagcacatactattgcatacaaaaaagatttcttagttctatttaacgtagataagaatattatcccattatcacttaatgcattgcttacagcattgacaaaaactggtaaattatcaacatgctcaattatttccataatagttataatatcatacttttcttcggtattaactaaagattctatatccatacaggaatactttaaattacataaaccacgttctgaagcatgcactctcgcaatattgatactttcttcactagcatctataccaaaaactttcatacccaaacgagacatagattctgataataaaccacctccacatccaagatcaagaactgacaacgacttaaaatttgctttaggaataatcttacttatataatcaacaatatatctcattctcaaaggatgtatatcatgcaaggcttttaatgggccatgttcatcccaccatttatcagctatttttgaaaactttaataactcattttgatcaaccgtttgactcataaacaattatctatttttgctattctttgtacatgcctcccttcagaaaattttgtagtaatgaactgataaactatagactgagcttctccatgattaatatatctagcaccaagacaaagtacattagcattattatgctcacgtgctaacttagctacttctacattataacacaaagctgccctaatttttctgtgacgatttgccacaatactcatgccaatacctgtaccacatattaaaataccgaaccctaaagtgttaatgacacaatctacaacattttgtacataatccgggtaatctacagcaatactagattccatgcaaccataatcctctactacataacctaaattgcttaaatataacttaataactaatcttaactctattccagcatgatcagaagaaatgaaaattttctgcatagtcaacataatttaacatgatctaatatctatatgaaatactatgaaaagtcaatatcataaacatagtcacaacccaaacgttacaatttctctttacaatttcaagataatggtgtaaaaaacctactataggttttatagtaagtgtggatatatgaacaacgggaaagaagaatcagagaacatcataaaatgcactttatcttatttaaataatacaaaatcttacacacatgcatttaaaaaaaatatcatagaagcttttgaatccggactaataacagaagatcaatttactcatatgatatatcacgtaacaaagtttataaaaaaaattgaagtatatgaaaatatatttctaggaatatatcatgattacatcacatgcggttagtattatgctatccttatcaacaacaataattaactttcctcacaactttaagaaaaattaataataagtacaatctctttccttatcattttatagttttatgtagatatacaaaaaggtaataatattcataaatgaatttttagctctattacatcaaaacatattcagtatatatacttattttaaatactctatgcccatacagtattttatatttagaaaatccgtatcgatctcaaataacgtaatattagcgtgcttgcacattatggctgtttgctgcttgaatcaggcgttttttataattatcattgtctttccttataatcgaaaaatatctttcaggaatagtcaaaccatctttaccaacactctccatatctactaaaaaacttcccttaaccctagcctgataaactgtacgtaactttttagtttcttcattaactgcaaatccaataacacatattatgcaatctagagaaatcactttatctaataatttcacagcattatataaattgcctattccaggcttataatgtccactttcattactaatataatgaataataccattactgacacttagtaaaccagcacatattacaggcatacccgcagctaatgttgaatgaaaatatgtttgaccttgagtacgatcacatactatatgatcatgagttattaaatttccctctaacgtaattacatatgcaactttactatttgtactatatatttgaccatcataagaacagagtacaggtctatttttttccctgataaaccttgtatgatatcgtcgttctgctaaagaaaaccattttatatccaataaacaatttcgataaaatacctcaacatttagtttattcttaaaactaatttctttataaactatatcatatccttggctatattgcattacacctgtagctgtcattgataatataggtttacgaaaaatatccatactaacttgttgctcttttggaatgttataccaactcttcgtagcaatcttcctaatacccataacaacttttcttagaaaaataagactatttttcctataaagtttaacaatttgctgactaccttctttttcacgtacagtatgtaacaatggcatcaatattataaatataataagtttatttaaatattatattaattcatttatatagtaaatattataataacccttttaacaataaaaaaattaaaggaataaaacaacaacaaacacaaatatacaaatcttgaataataaaacatataaaaaatatgcattatcattcaagatcacactacgatatgcttatataataattaaaacatgaaattcagattataataaaagcttataaacaagcattaaatattacttactaactttctaattgacataacagagtcattaaatacattcttttcctcctcagttagttgaagttctattactttttccactccatttttaccaataattacaggaacacctacaaatagatcatgaactccatactctccctttaaataaacagagcaagataacattaatcttctatcattcaaataagagtcaaccatcaataaagcagactcagcaggtgcataataagctgaacctacctttaataaatttactatttcttctccaccttttctagttttttctataatctcattaaccctatcttgtgtaattaaattcattttcaccagatcagcaatagatatcccaccaactgatgagtacttaactaaaggaagcataaaatctccgtggccacccaatactatagaactcacactatctactgatacattcaattcttttgcaataaaataagagaaccttgctgcatcaagtaccccagccataccaacaaccatattacttggcaaatgagaatatttatgcatagctaaaaccattatatcaagtggattagtgactactacaacaaatgcattaggagcatatttagcaatattttctgctacttcttttataacatgcacattagtattaatcagatcatcacggctcattccgggctttctagatattccagcagtaacaatgattgcatcagcaccttcgatatcagcataattgttagtacctaatatctctccattatgttttgctactggtgaagattcagcaatatctaatgctttacctttggctataccaccattgacatctaataaaacgacatctcctaaatttcgtgacctaactaaatatgctatcatgccacctatactacctgcaccaataagagcaatctttttacgttttatcattatttcctctactttatttcaagaccactacttatgaagtttacctgattatagaatatatacaatacttaatctaactaactattacttttcgtagtttctaatacaacactaatattaccatttgtaccacaagtaagaggcttatataactttaaataacagtgataaattttttcatttgtcatgatataagctaataaatctgatgccatcgtttccaataataaaaaacgacgcgagttaacaaaattaattaaattatcagtaaatatactataatctacagtttcatcaatatcatatattagatcattacaacaaagagttaagtcacaatctattattattttttgttttataactttctcccaacaacgaactcctatataagaatagactgtaaatccatgaatttgtattttcatcttaatacattttgtaataaataataaaaaagtacatcatcaataacaaaagttcaataaaacatctaaataactcttactttattataaattcttctgataccagatgtataattttttataaaatactgtcacatttagttttatatagtataaatatcaatgttgagataactgagagtaatgtaaaaatgtttttatataactacttgcctttctttaaaaaaaagaaacaagatcaagataccaacaaaatttgctattcaggaggaataagaagatttagtagtatattaatagatttgactattttaatatttatcttacaaattatacacaacgtatactcttactttttcatgcatgaaacagataacactgtaataaaaattatagaaaaatacaaaatgagtgtaccattaaccgcacaagaagaacaaattaaaaataaacatgtatttaaggctatttgtggacaaattattcagatgattgcactttacatatacgctgcatatagttggactaaattctctgcaacactgggaaaatttcttacaggattaagagttgttgatgcaacaacttttcaaaaaataacactatctcaatcaacaaagcgtatttttggatccattctttcttctattccactatgtttaggaatagtatggtgtaattttaataaacgtaaacaaacatggcatgataaaatagcaaatactgttgtagtaaccaataagagtttaaaaaattaccataataatcataacttatgattataaaaaacacattttctagataattctttactagtactactaaaaactaatctataattataaaaatgttcttgataaatattttatgccagtcaagctttcatctactttcttagtatatcaaacctcaaattttctaaaggccaccttgctcttggaaaaaaatttaaatttgaaacataaccctttgctaaattttcaataccagcccatcctatcataactccattatcagtacataacttacttggaggatacaatatttcaaaaccattatcatttgcacatactgacatacgattacgtaataatttattagctgcaacaccaccagttactactaacttattaatcctgtgatctatatcttttgacattacaatcgcgttgttaatcctgtttaccaatatatcaccaacacaatcttggaaagatgctgaaatattacataccaactcatgatttatacacttctgacctgcaataatatttctcacagcagttttaagtccagaaaacgaaaaatcacatccaggacggttagttaatgctcgtggtaaagtaaaacttccactatcacctaacaaagacttctcttcaataattggccccccaggatacccaagatttaacattcttgctactttatcaaatacttcacctaaagaatcatccaaagaagaacctaacttataataacaccttacatcgtaagctaccaagaactgacaatgccctccagacattattaacaataagaatggaaaatctatttcataaaacatacgaataattaaagcatgagcctctaaatgattaatttcaataataggcttaccagtaacactggaaattgctttagccatcattatgccaactattaaaccaccaataagaccaggacctgcagtaacagcaatagcatcaatatcattaaaacaaagttgcgactcctctatacaactaccaactaactcatataaataattaatatgagcacgagaagcaatttccggaacaactccaccatatgctgcatgttcctgctgtgaaagaattttatgtgataaaacctccttattactatttacaatagcaacagcagtttcatcacaacttgtttctatacctaatactatttttaatttatccacactttcttattttatagctccaatttctttataataacgttcagcaccatcatgcataggagtaatacttgactttgccatatcttgcacagtaagagtttttaaagccccagtaatgctacgaagttctcgtaaatgagttgctatagactttactatcttatatgctaaatcattacttaactctgtagtagtaaccagcgatgccttcactgacacagtctgtatatctggtgaatcattatataacccaccactgataatatctttttggtaatagggatacttagcatgtaaatcatctattaatctatcatctaaaggaataaattttatatcacaagttgcagatgcttcctgaattgaagcattaggatgtccaatcacatctaccattacatcaattttattatcacataaagcttgagcttgctctgatgattttaattctgccatgacagaaaaatccttcttagtccaacctttttctcctaataattttaacattgctacccttaccccagtaccaggactaccaatattaactcttttgccttttatatcatcaataactgatatattggagctttttttaacaacaatagtaagatactctttatgcagagatgctaacattctcaaattatccatcggaagcattttttcataaaaccctaaaccattatacgcatagtactctaaatctgactgaacaatacttatatccatattcgaataacgtatagaattcaggttatatacacttccagtagtagaagaaatagaacaaataatcttattatccttaccataatcacttgctataaatctacaaatactacctcctatagggtaatatacccctgtcatagaaccagtaccaattaaaatatattctctatttaaactatcatctgacgaggcaattgcattattaaaaagtacactaataataaatacatacacaattaacacttttttcattaattttgcctcacatttacagcaccatatattatatcgcaaaaactacttacctttaaactggcactaccaaccaatacaccagacaattgatttatagcaataacatcctttatgttactctgattcactgcaccaccatatataatattagatttactatcatacgaccttataatatctaaagattcagttatcatatcaatagaaggaatagtattacttcctattgcccatacaggctcataagctataacaaactcaccatgtttagggaaagaattataacactgatctaataaagcattttttaacataccattttctctatctaacaaagtttccccaatacaaataattggaattaaccctgcatctattgcagattttgccttcaactgtacacaataatcagattcataaaatatgcttcttctctcatagtgacctactattacataactgcaaccacaactatacaacattttagcactaacttccccagtatatttcccttcagattcataaaaacagttctgtgcaccaagtttaatattgggagcacaatcaactatcttagaacatgcaataaaaggtggacacaataccacttctacatcagcctttacattaactaaattagcacttaattcttttgtaaaagaggaaaaagtaagaaagtcaccatacatcttccaattagcaacgatgagcaatgacataaaaattactaaaattaaatgtgccggctataagacttgaactcataaccctctgattacaaatcagatgctctcccagttgagctaagccggctggaactttttgtaattctatatataatattataaaagtcaatacccagaatcatattttatatatttaatatcactttacatgtataataaacataaattaccatcatatattcttataatcatgaatcatattagtaagataaatcctaaaaaagaattaagccaatgttttatttcgtcaacccatattacagatcaaatagttaactatgctggcaatatcagtgattactcaataatagaaattggtccaggacttggtacaatgacttattctatattaaataaaaaccctaaaaaactaatttctatagaaaaagaccgtaggttatcaacaatacatgaaaaaatagttgaagaatttcaaggaaaatacgaatttatattatcagatgcactaaacatagatttacgtgatattattgaacctccagtaaaagtaatagcaaacctaccctatcatatagcaactactctattaataaaatggatggattatattaatttttttactagttttacattaatgttccaaaaagaagtagcagatcgtatagtagcacaaccaaataataaaaattatggtacactatctatactcattcaattactatctaatgtgtataaaatggaggattttggaccagaaatattttcacctcaacccaaagtaatgtcatctgtaattaacattattgcattaccagaacccagatttcatgtaaattatagaaagttatctcaagtattaaaaacaacatttagtgaacgtcgtaaaatgatacgctctacattaaaaaaacttaccaataatgcagatgaaatgctagaatctcttaacattgataataatttacgtcctgaaaacttatcaatagaacaattctgtcaaattacaaattgtataaactaaatatcctatgtatgtgaggctttcgatataaattaccaaaaatatattgttattttaaataataaacctagcttttacaattcatctaacaattttctggtataccttttgaagtagaatattgaaaatttaacggagaattagggtatattacatgatatatatgatgacatgccattgcagcctctgaaaatcctgtaagtattaacttaagttttcctggatatgtagctatatcaccaactgcatatattctattgcgatttgttagacaagtctcagcattaacaagaatttgatagttttttacttccattccccaattcaatataggaccaagatttgcagatgtaccaaaaaatggaaataaataatcaacttgtagcgccatttcttcatgattcgtaatattcttaacaattacagaatgcagtttaccattttcaccacataattttttaacttgatatggaacaataatctttatttttccactctgtgataaattatccatctgcaatgcagtattaggagcacaacgaaaatttttccttctatgtactacatataactgtttagcaaccttagaaagctcaactgcccaatcagcagctgagtcacctcctcctgctatcataatatttttatcacaaaaatctgaaacctttctcacttggtaaaatactgatttattctcataatcaagaatattatctataggaagacgatttggaccaaatgctccagctccagcagcaatgataataactttactttgtactacaattcctgttgtagttcttatcaaaaaataatctgagtaatcttctattttttcagcaacttgtcctaacaaatattgaggattaaaaggctcagactgcttttttaaactatctattaattccttaccattaattactggatatccaggaatatcatatatcggtttctctggatacaatgcaagacattgcccaccaatttcacttaatgcatcaataacacaacatcgcattttcaacataccagcctgaaatacagtaaatatcccaacaggaccagctcctattaccgcaatatcagttacataatctgtcatatttttctcatatattagccaagttttacgctaataccttaaactaaagaagaaaatttatctagaaattttctataaaattactgcatatactaaatatcaaaaagctttacaataaccaaattaagaagattttcacaaaaaatatatatcaatttatatgctactaataatacttataatcataagttatggaaaatataacatttatatttcaatgttaaccaagaaaataattattaagatactatataattaattatgtacacacattacaatacccagtccaatattaagctacataaaactaactttacaaatagttaccactaatatttaaagtatattctaataaatataacattaagcaccacaataacaaatacatagtaaatcataacaatttacctaaaacatatagaacaacactatttattttattatccagcaattgtaatgccatctattcttattgtaggagaattgactgaactaaaaaataccaaatcatttgcaatggacatttcagaaaacatatattgtaacttactagcaatggtgatttcatttactggataagatattttaccattctctataaaaaatcctgatgcaccttgactataatcaccagtaattaaatttactccaaaaccaaaaagatcagtaatataaagcccactttttatatctgagattaactcttgaacagacaaaattccattctgtatataaaaattgctaacaccaggacttactgatgcattagaatgccttacagcatttccagtagttttcagtttcaacttattagctgaacgtatatctaaaatccaactttttaatataccattttctactactaactttttattaccaacaactccttctccatcaaaaggccttgaagataggccagataacattaatggatcatctactataaaaatgtcatctgaaaaaatctttttattaatataattatttaaaaatgaagcttcattagctatattatccccccttatagcactggcaaagttttttaacaatgtaccagctaccctattctcaatcacgattggtactttacaggtctgtaattttccagggtttaatctcttaactgctcttaatgcagcttccttacctatttttacaggatctttcatacgacttaagttgcatacggaagaaaaatcatatcctacttccattttatcatctgtaccagcaataacagaaatactacttacaaaattagatttactataagaacctataaaaccatttgtagttgctaaaacaacatctgttataccatgagaaaatgaagatccttctgaattgacaacttgattatcataagataacgcagcattttccatatcttcaacaatttttttacattgatcaactgtaatattagtcttatctaatatcattaggtcattactagttaacaaatgttctttattaataaaatcattatataaagaaatatatggatctcctgtagataattttgccatagcaacagcttgatctatagattctgatacattagaaagttcattagaagaaacacatgcaaattgattattattcacaataactcttattcccattttacagtttttagattgaataacttcatcaatcttatggagacgttgcgataaagataacctattattctgataaattactacatcaccaatgtaacccatactttttatcttttttacagcatcttcagctacatttaaaatctccaatttatcctccatcaaccaatactagaaaaaaattctcttcttaattccatgttatcttgaaaaactccaattgcacaagtcgtttgtaattccaaattatgcttgtcttcctcttcacagcatacaatacaatcatgtactgcttcaacagcaacaattatccctttcggagctaaacaatgatctaaggcgtttgctatttctacagttaatttctcttgaagttgcaatctttttgtaaaacagttaattaattttacaattttacctactccaaatactaacttatcaggaacatacccaatactaattttacctctcattggaacaatatgatgctcacaatacgatgtaaattcagtatttttaaaaatcaccatatcattataattctcattaagtaaaactaaatcttgcatagaatatatatctacttgatatcctgaaaaaaatcttttatagacatccaatacacgtttagcagtattaacaagaccttctctatttggatcatcacctatccatcttattagtaaattaacagcttcttcggcttcactatcagaaggtttgccatttctcataaattctcacttattaattcaacgattcaaaaccactaattatctctattaagtcagtagttatagaagcctgcctagaacgattatattctaatgccaacctatttaacatatctttagtattacgattcgcagattccatagcaaccatacgagaacaatgttcactagcagaattctccaaaaacgcaatatacattaaatttagtacataacccaaacttatagtagataaaacatcaacatacgttggttcatattgatatacttctttcaacaacataggaattccaagattacaaggaattaattgttgagcatcaggtttttgtaatatagtcgtgtaaaatttattaaatagtatcatgacattatcaaactgatcaaaatcaataccactattatatacaaaaagcttaaaatacaaaaaatctgtaatagacttagtattagaaaatacattcaatatcttatctgaatattgactatacatcatatcatatgcctttttgccaaaaaatattaattttacttccttattactactttctaacttttcaacataagatttagtaaacttaactatcaaattattaaaattaccacataaccctctatcagaagacattacaaccaataaaactctttcttttttagctatagaagcacaattatgcaccccatccgaaggaacataatctacaatactactaagctctaataagtgttttttagcattctccaatttttgctgaacgcgatgcagcttagcagcagatatcatctgcataaccttagtagtcttttgtatagacttaacactttttattctcaataataaagctttaagattggccataaatcttaattaaaaatacctaactaaagtatattatcttttactagttacacaagaattttatacagataaaaaactattcctattacataaagcgaccgtgtttttttcttacatcaccagacttaggagaaggtaaaggtgctacatcatctaatgaagagtcactactactattaattactccttgtaatcctgaagcaatctcagtaacactagtatccatcaatacatcaccagatccctttcttttgcgccgtgaagaagattgcttatcagatgcctcagatcctttctcctgtgatactaaaccttcaaaaaatcgtaatttctcagaaaaatttctcttatatcgttcccctgccctctttacaattataggatccaaagcgtcgtctgcttcagtaactccactgcttccttcttctcttatactatcgaaagataaatcttttagaccttcttcagactcttgactagtatcctccgaagttttagaaaatccaaaagcttttaacactaatttcgtacttttcaatgcatatgatgacgacgttatatcacctgttttttgacacgcttgttctgatgatgcggcaacaccaccttcagtgttacaaacaaccccatcatccaaggataaatcttctagagtgtcatcatcacattgacttatatcccatcctgttctagacaacttgtaaagactatctcctctaaattgccctgtagatgatacatcatcagcagataaagattttttacttatctcatcacctccagcagtaggaaggtctccttcacttttagaatgctttataactcttggtatcaaccctggcattaaaatttcaccttttacagatggtttcacgtctttataaatcttactgtcattctcaattctaagttgaagtccaatatttcttaaaccctgtaaggcttgtttcaatatatcctcagtaacatgaacttcttccggtaacaacgtaggcgatgcttttccaccttttcctgatccttttttagattccacacctcctcttaaatctgaacttagttggaatgctgctgaaccgcgaggaattttagatgtacttttaccttgttctgatcctgctactaacttttcatctgcacctgatacaacactttgatcaacagtcatagcttgatctgaagtacctggactagatgctgaacttgcacccaccactttatgttgctgttgattacttaaaccgcttggtaatacacgagacgtgcttctatcctcctctgatcctgctactaacttttcatctgcacctgatacaacactttgatcaacagtcatagcttgatctgaagtacctggactagatgctgaacttgcacccaccactttatgttgctgttgattacttaaaccgcttggtaatacacgagacgtgcttctatcctcctctactcctgatactaactttttatctgcatctgatttaacaccttgatcatgctgaccctgagatactatatcaccaccacgttcttgtaccattaaactactatctacagtatcctgatccggcaatgaaatttcagagcccaacaaagtcctattctcattacagaatctttcatattcttcctcttcctttaaaccaaaatctaataacacttcttgtacactttctaacacttttacaacatttggtttttctgtcactgataaactactaagacctacactacaaaagatactcaacatacaatttttaagacttttacactcttgtaatattgacacacaaatctcacgtgttaatcctgtatctgaacaatcagatgctcttttaatcaattcatcatattttccaaatacaatattagacaatccacctaacgatataacttgattattcaatgattgctgtaatctagacagtccaattgaatccccatcatctaaacatattaactgtccaactaatgctttaacatcctgttgtgttttattacatgtatactcaaatactgtactttctggtaccacttctcctcctggttgagtaggcttcccatccacattccatggattatccaaagaagcaaaacttactaacaatttttctgatgtctctcgtatacttgcacataatatattttcttgagtaagctgctgatttgctacgtcatgcaaaagctttatacaattttttaacactgctaaatcttgtgacttatcgctcagagattctttcttagattctaaaatttcacccacttcaaatacatttgtcaaattggcgtgacattctttgactatatcaaaaatgttctttatcaattctgtagatggtaacgttataccttctcgattatttagtatatcaaaacgttctttatttcgtttagacagttgattatattgatcacataatgctttaacattaattaataattgttttacatcaagtcccttacttccatcacacaatttttttacatcgtgcaatataccttgaaatgtagataatagatcttctgatgtagtttgttcactagtaacttgctgttcacttactgcagatgcacctggtataggataaggtttacttccttctgtctgcgacgctaatgtagatgatagatctcctgatgtagtttgttcactagtaacttgctgttcacttactgcagatgcacctggtataggataaggtttacttccttctgtctgcgacgctaatgtagatgatagatctcctgatgtagtttgttcactagtaacttgctgttcacttactgcagatgcacctggtatagaataaggtttacttccttctgtctgcgatgccaattgagtcaaattcagaccagcagatgataatttttcacgtattttgtgatattttgataactcatccctagatacattagttattaacatttcagcctgttttgatacatccactaacataaaagattgcacatcttcaaccatactatctagatctttgttatatttgtccaatatttcacgataaagatcatgcactagttctggtgctaatgtttcctcagcagctaatccatttaatattgctctataactttgaaacaatgtactatatgtagaacacaatttttttatattatactcattcaaagttttatcttcaggaaataaatacactcccattgattgccttatctgataaaggttatgtctatcatccagcaatttcacttttctatcttctggtataatattttgtggtaaagttaatacaaataactcaaaatttgctatatcttcagacacatttggtataaacaactcaacacgcctttcatagtctggtgtcatatcctctgatattatatcctctgatattatatcctctggtatagtatataattgactcttagctcgtcctctcactggaaatgtttccttctgtttacctttagacagtaatttactacctttcacatcaccatgagcaaacatttgatcatccatgcctacacgagactgcggtgatgataatccctcaactgcaggttgttgtatcggtaaatgcaacttttgagattgagatgcagatggtaatttactacttttcacatcaccatgagcaaacatttgatcatccatgcctacacgagactgcggtgatgataatccctcaactgcaggttgttgtatcggtaaatgcaacttttgagattgagatgcagatggtaatttactacctttcacatcaccatgagcaaacatttgatcatccatgcctacacgagactgcggtgatgataatccctcaactgcaggttgttgtatcggtaaatgcaacttttgagattgagatgcagatggtaatttactacctttcacatcaccatgagcaaacatctgatcatccatacctacacgagactgtggtggcattggtgatattacatctacttgctcatttccaagatgcacatcaaccaaactagatgctgacacatgtgatctagtaccagatccaggagttacagaagatttaggtgtagtactctgttgaacttgacttgtaggtttgatagtatcctgaccttgatctaatgacgctgcagatctcctacgagaaatatcaccaccatgatcatggtcacgatcatggtcacgatcatgatcacgatctctatctaatgaagctactgttttagtatcttgagcacgagattccttatctttccatctaccattctttaaagcagctgctaactctagcccaccaacataaacgtaacatgcatcaaaatttattttttcaccatgcatgccatacttttgtgcatctttagcactaagagatatactaccatcagaatttacaacaacactaacctcctgctttggtgcacctgctggaatattaggtgtccaagataattttagttttacaaatccctcagtaacaacataatttctctttttaccaacactgtgtacatatcctttgtctttattagcaaaattaaaaggaaccattgttaacccacaacttttacacaaagaactagagaatatgtcagtaatttttaactttgcacgtcccatgttagcaaacaatacaccaccagctatatcaaaccctacgtcatcataattcatacctgcttttaacacgacataacgtttgaagtcagatatgcatctagatttaatgtcataatattcattcctaccatctatgagagattgcaaaatatcaactttttgatctggtaatacttcattaagtacttgagaagtagtaatattattcgcaagatcagatggagaaagtcctaatctatttttaacactaagtgaagcatttctagatactaaaaattttacaagttcaatatgatttgctgtcaccatattaggagagaaccgcataaagattaacaatttatgtaaaggtgtattaccatccttatctcttttattaatattagttccggtcgataatacttctgctaccatgtcctttgaaccagtaataacagccttatgcagagatgtatcaccatccatatttatattacttataccaatagctgcatactttgtgcggaggtatttatgtaaatcaacattagaagcctcagcacaatttatcaacatagcattaaaatcacatgaatctgctatcttgtttttgcctaataggtcttctaactttttgaatataggataagcaccaggaatacgtgctacagtttcaacacaattttcaaatcttaaatttctattatcaaataataattcctgtaacaactttggatctgtctcttttaaggtagatataactgtatcaaaaagttctaatactctagtatgatcatcaccaatttttccagaagcaatatcttgacataatttttgcaaagcattatttccatcaccatctgtattagctaaagtatttctaacaataccatcatttaatatttttcttaatcttctataacttagatcaataacaccctggtgtttatcaccattatcacttaaaatatcgttacaaacattatcaaataattcactaaatctatatcgtaaacaaaaattctgctgcagtagattgtgaacatcgtcaatagagtcacattcaagaaatgtaccctgtgctttactaaaccgttgagcagctttctctgatatttcagattgctttgttaaaagctctataaatgtaccaagattattctcttgatcactatatggaaatattaacctttcctgcaatcttttcaataaatcaagcgctgtctcaccatccctatttctatgattaacagaaaaactatcatttcttattaattcacaaaaataataccggattcttgactctgacaatgcttctgtattttctgcaaagaactctgcaaatttatgtaatagagtattaccacggttatcaacaatatttggatttaacatactattagaagttactacagcttctattaaatcaaaattaccagacgacacagcacgttcaataatagatttctcattcgataaagttctaagctgcaatacagaagaactacgacttctactaataatgtcaatatattcagaaagattagccttttgttgtattaaagattctatcttttcctgattatccagtatttcttttttacttctactaacaataatttcattttctgggaacaaatgatcatctaataactcttgattagataacatacttcgatggattgtagacgtatcttctgctggactttgtgatatacccaaagaaggtataaaacgttcattactactatctatatatccaccttcatcatccaaacctagtaaatcctgaccactagatgccctagataatgaacttggagctatatcatcatcagatgaaaccaccactgatggttgacctggtaatgaactagtagcagcaacatactcagctgtgcccgaaaatggaagttttatacttagcgtacttagtgctgcactactactagacctggaagtacctacaccaccagctgcttgactttgtgttgcaccactactagacgatgtagacgctactgctgcctgatctggtgctgtactactactagacctggaagtacctacaccaccagctgctcgactttgtgttgtaccactcctagaggatgtagacgctactgctgcctgatctggtgctgcactactactagatctggaagcacctgcaccaccagctgcttgactttgtgttgcaccactactagacgatgtagacgctactgctgcctgatctggtgctgtactactagacctggaagcacctgcaccaccagctgctcgactttgtgttgtaccactcctagaggatgtagacgctactgctacctgatctggtgctgcactactactagacctggaagcacctgcaccaccagctgcttgactttgtgttgcaccactaccagatacctgtaactcagctgttgacaatgtagaagttcctaacgcatcgccacgatcatcacgtaacatttcttgattacttgcaacttcaaattcatgagataacaagcgtgccttctcttcaggatcagaaacaccttccactacacgcaataaacttttttgctgcgcaatgatatcagatcttttgctgccaccaattctttttaagaatatgctagataatcttttactaccacttaaaaaagcagcatttaaaactcgcttatcatatttcttttgtgataacttctcaagagtcttatccaacctctgcgataatattatattaaaagcttgttcacgtacatctaaactttgtatccgaccattagcagcatattccaatagtccttgtcctgctttatcggaagctgctgccaattttttattgcattttattaaattctcaaattcaaaattaccactagtatctttcattgcactataagcacaaatatgcgctaagttagtcccttgtgatgtttttgaatttacatctccacaaagcaacttaataagttcatacatttcatagttgccagtaaatgcaatatattgaaaaaaagataacccatctgaacttctaacttgattcaccatatctgttatcatgtttttcagagatttattctttgtatctattgcatgtttataagctcttttagctaatgcacataaaaattcaagattctcttcgttaactgaatgaaatatgttattttttttactactagaagaacggataatatcctctacattaaattgattcactacataatcatacaatgctggatatttgtccaaaacatccttggcatgtgctacaatcacacgtaataaattttgactaactactggattacttgatttacatacaatgtcattataatactctaatagagcctcttttaaataactccgtattctaggattaacatcttctctttgtgcaaaatcatatagtgtctcaaaagatttaaaagtacacttgtaattattacttaaatatctagcaagtaccttatataatggtagtttcgtatcatattgctttattaataaagaaggatccctctttataagttcttttaacaaatcaagtctattagataatactgcagaatgaggtaggacactatcatccaatgcaaatgcaggattactctttaaataattacaacatgtttctaatagattaggagaacaaagagctaatcctaaatcactgactcctccatcacaagatgaatcaaaatccctcttctcttcccgaatcaaatactgtaaagcctgaggattattttgtacaataacatctctaacactaaatttttgattatacgaaataccaggcacactctttaataggttgaaagctgacaaggcattagcattacgtacaacatatggtaaaatcttatctgacattttaggatcagtagatttaaaacctagatctgacagaaacaagtatatcatgtctctatcaagatttaatttaggatcaataatctcccgtaatagaccaagtaggtcttgttctgtataataacgtagtaactctgttacacactctttatttccaactttacaagcatatgctaatagactatgtcctgctattttatgttttattaaatttacttgctgtttagataaagacttcccagtatagtacctaatattgaacaattcttttattaaatcaacatcttgactatcaataacatctttaatgaaaacctcattaatcatcaaatctcttgacgacttttcattgcattcaatctcatgaataaagcttacacaaagtttcttataccctctttgagctgccataccaaaaggtgtaattcctttcttattaggttgaagaaatgccttcatcaatacatcttgtgaaaacctttcatcatttataataacttcagctaaggcatattgatcctccgatatcatagtatgaaaaatattattcttatcatcaccatatgctgccattaattctttagcatcaatctcctttataaaatgcttaatcattgacacattgcgttttataacagcagcttgaaatggactaaataaagtagacaacctattcccattcaatggatttttaacatctgcaaaaagactttttattttcctatcctgatttatagctttatatcctttttctaactggatccactgctcaacatttccaagcgccgctactaaagtaaatatactatgccctgtcttgtcatgacttctttcagcatatcttttcacatcctcactaaataactcaacaatctctttcttaaatttttcagcatcatgacttactactgttggtatatatcgtgataaagcaccaaattggcctatattaccctctgctaaagacgatacagcatctctactaccttctccttctccgcttcttgattcggaagttgtgtcaacagccgccgaagctccatatatatgcgttagatcatcacagcacatggttgacactaattcgggattaatccgagcataatattgcatcactacaagattattatagtttcgagcattctctaatattagttttgatattccatactgtgaatcaagttcctgaataatttcttgattactttccaaaatatctataacatcttcgtgattaatttttgcaatgtcactaaaaagtaccatcagatccgctatacatcctaatggatcatgatctaatttagcattacttttaattaattccttatgtactgaaattatatgtttaactaatggaaccttatttaaatctgatgcagcctccaacaaactcttaccatcttttgaataatatataatactaggacagtattttaataatgacttaagcttgtttaattcattattattaactaaatcaaatacaaaatttaccaacttgttattaagtgtatctacactagaattgtaagcactatagtttcctttaacaaaagttcgtgcacgagataccatattaaacaaggtttgaagctgctcaggcaatgattctttaagtacattatcaaacacacgactattgacagataatagatgagcaaatctcattaagtcacgaccatcaatttccgactgcaatatttcattacaaatctcaggggagatatcacttaatcctacactttctgcagaatgtcttaacatacttacaatactagaaactccaagagcatctactactctatgtaagaagtcacaatctcttactttggctatttctttagcaaaaacatctttattagttgacaaaggcaatattcgtttaagtaattcaatatttctagattcaatagcatgtttttctataccaatattaataccaagttcccttaattttacataatatgcatcacattcctctaagctagagaacctcttataggctttacttactctcgaaactaactctggatcatttattgaataaccacaaaactcttctctgtaattattcaacattgcaaaattattatcatttaaattctcaagcagagcatattttagctctcgtaattcccctctcgagatattgttttctatttctgcttgtaatgcttttacaattttttcttttttgaaatattctctttctatcccttgttgccttttttgaaattcccctactgctggcgatgatgctgcctgttcaccagactccatgatcttatccatctcattttgtaaggccaacttttgggacattaatttacataactcttcttgttgtattactaattcctcacttaatctcttcacctgacctactaattcatctgataatgctccatctaacattgttaatgatgatgatcttaagtctaatgattgtaatattatatttcttatttgttcttctaattgcaactcttgacataacattcctgatactggcaattctttcaatattccctgcaatacccctcttttactattttcatttactaattcttgtcctacttgtatctctcctctaatagcatcttccagacacatcttcatatgtaataaagccttctgatgtactattaaaaatctcaactctttccctgataaatttcgtttagaacctgataataacttttgttcttctatgttatttaatctcgcttgcgcttgttctacccttattaacctctcacttaggaacaatactgaccttgttactcgtattaatgcagcaatacattctttttgcttctctaatagttccctctcttgacttgtatgctcttgattgtgtagcttctctattttctctaatacatcttttcgtaatgagagttgattccttaatgctgattcaacgtccaaaccatttcgacattgctttaagcttatttcttgttcagctaattgtttttgaagtgttagcgtatttcgtaacttgtctacaggcacttgtctttgcggtacttctcgtaatgcttttaacgttctttcaatataactattatattcctcctgacctttttttagatttttctgagctacctctacttcttttgctaactgtgactgtagtaagttatccacaaacttgtaagatctagcataatctaacaatgcactctgcgatcttgcccgctgtgtctctagtctttccaattcttcagacaaattgtttatcatgaacacaccagtctcaagtgatgatgatgatcgcacctcatttactactagattacactcttctcttagagattttatataagatgtcatctccattaaatcttctataagcttttttatcctttcaatatccagtaactttcgattttccgctgccacatcatcactaagaaactcttgctccagaattcgtagttcttgttgtaactgtcgttgtttttctccatcttcttctctctcgatttgagatctcagttcttgcatattgtccactttgagctttaaatatgacaataattctgactcttttaaacatgctgctctcaattcaccatatagttgatctctaacagtttcctcccttccttccagactttgcagcttcttttgttgttctattaacccttctacttgtcttttactttgcgctatatcttgtcgtttaatcaaagctcttacatcgggtgatgttggaaaaataccagcaaatcttgttaatacgtgattcaatatttcattgttcccgcacctcgctgctacattaataatagtatcgccatttttagtacgtgctaataggtcacaattctcaaatatttcttctaaatcaatatcaccttttagatcagataaaaatcgagacgctacaagtaaatgaactggtgtctcccctaacttattttcttcagataacacatgacgtagacctaatggtgtacctgaatccggatcttgaatacttgcatacaatacctttaatctatcaagcacaacagtaaagacttctttttgtccaggttcagcagtatagtttttaaaaaggcaatgtaatatattatcaccattactttctttagaacgagcatgataaagtgcatcttgcaaacctaatactagtttgcaacactcagaatcattagaagatatagcataatgtaagacaccacgaccttgaccatcagtaaccttccagttcaccctctgtgaaatctttgtatgacgagttacattaacatctttaaatgcacttaaaaactgctctccagcctttgcagccataagtagtggaaactcaccatttccatcttgagaatttatgctatcactaatacaatactttaaaacttccctaaagatttcaggattaacaggccttttttcaccttcatgcaacttaagtatatattgcaatataccacttccctctatattacaaaatattgcactagatatctcttccttacttgatgactcaaagaaattttttacccgtactatatctccagatttaatagcatcgtataaatcctgttttcccatatcctttaacctaaaatatttacaaaatttattataataatattcaatttaaatatatatattaacttatttatgattaatcataatactactatcacaatatgaataacaaaatattaaatttatcgttactgtattaataaatatattaatttctttataaagtataatacatcatatattaaaataataaaacaaatttatttaatcggagatatattcagtggatctacccacattatattaccatcacttttagcatatatcatattaattctattactcttggcattaataaataaaaaagccggtaaagataataactccatttccataattgcatccccaatagtcatagtctttacaaaaacatcttcctctattatcaatcctgaatcacttatgttattaacatcatatttttctatttcattactatctaatacatatccaaaacatctcatctgtgcttttacagaatttttattatgacgatatttattaattctttcacctttatgtttttgtaatttaccacacaaatgactaacagcatcatctattgcattatatgctgtatctgatgttttagaaatcctaataaattcactcttgacatcactaataccaatggtagaattaaacaggtttccatctttagataagatcatttttatattaactgttgaatcatctataaaaaattttgttgtgtgtttttttatggcttcctcaatgtaatctttaatgttatcagtaatgtcaaagcctctagcagtaataagtatgttcatagctatgttttaaaaattatattaacaattaatacactaaaaccctaaaaatttactatacatcatcatatcactttgatataatacagcgttgtaatcaagtttcatatgtcaatatgttaacaaattctatattttccctaactcaagacaatttaatgtcctatatcaatgaagtgcatgcatttccgattttgtctcctgaagaagaagacaggttagcaagaaattggtatgaaaatgggatcgttgctgacgcacataggttagttactagtcatctaaggctagtagtcaaagttgcattaagctttaaaaattatgaattgcctcttatagagctaataatggaaggaaatatagggctgatgcaggctgtaaaaaagttcaatcccactcttggctttaggttatccacttatgctatttggtggatcaaagcttttattaaggactatattcttaaatcttggtcgtgcattaaaattggtacaacacaagcacaaaggaagttattctttagcttaaggaaaattaagaaaaaactttttaaatataaccacaatattacaaaagaagatataaagctaattgcaaataaatgttcaacttctgaacaagaagtagaacagatgaacaggtattttctctacagagatagatccctgaatgaactagtattctctaatgataatcaaaatggagtcgaattacaagagattataaagtgtgataccccaaaccaagaggatacatatttactaaatgaagagttaaatataaaaaaggctttaatttcacaagctttatcaacactaaatgaaagataccgcgacatattcatcaggcggcgactcatcgaagaaccagatactttagacaaattaagtcaagagtataatatatcaaaagagagagttagacaaatagaaatgcatgcttttactaaagtaaagaattttattatatctgaaagagaaaaactaggtcattgtaatatcaatagttaaataagaatagcatatcgatctaactatacgcttaacataaaaagaaactaatatacattaatcttagaaaaataaaagaagatgttaagagaaataagacagaactcaaactgtaaatacaagcatctatacaaataccctaatgcaataatcgacctaccataccaccaaaactaggataaactaacaaatcttcacttcaacaatatagtccaaattactatataaagaaaaaatctaaggtgaaataatttaatgtgagtttcaaaataaaatcacaaaaaacactttataatagcaccttgaaactactttaattaatatccctgccttgctttaaatcttggatttttcttatttatcacataaatacggccttttctgcgtacaactctacaatccttatcccttacttttgcagacttaagcgacccaataactttcatctctcttccttactcgacaataaaattacgtactcttgtggcggagagagagggattcgaaccctcgatacgggttaaagccgtataacggtttagcaaaccgtcgccttcagcctctcggccatctctccccttaacacttcatatttttacaaaatttatttataaaaatgcagaatgtaacacgtattataaaacttgctaagcaaatttcaataaaattctatttactatcaacgttcaaccaacatattttttcaaaccttctaatacttttttaaatagtaatacaaaaccttccaatgaaaacataaataaactgcttcctcaataccagatcaggtatatataatacatcaaatacaatattaatattactatgacaaaaacttctcaccacagcaaacaaacttttatgcaacaaaaaaaactagatgaatttgactatacaattgatgatattattacaaaatatcaaataaaatttgaaaataaaatggaagatattacatccaattttttaactcattttcaacactctctagaagaggaattaatatcattaattaaaaaaatatattctcataactttcaagaactcaataaataccttgttgaacagttattaaattctaacagcttacaaagcttaaataaatatgagaaagacatcatcactaaaatatttaacaaaatttcttttagtgtattagaaaacttagttttttaacaaaaaccttaacataaaaaaacgttatcaatataacatggagttatatgctagaaagttctatgctgtgtattacacgtaaaattgtacctgtatcctcacctatcaccttatcagaagtaaaatccttcctacgcattaacaataatcaagatgatacattaattaataacttaattactatggcatctgaatatgcacaatggtatatagaaaaatcattaatgaaacaaacatgggaaatttcctgtagtagatatatacctggaaaaatacaattgttatttaatccaataataaaagtgaatcatgtaaaaataatacacacaaatggaagtgaagaattgatagatcaaaaatactatcacgttaacacagtactatcatacatttcatttaataagcatatccatggagatagaatagaaattctatatgaagcaggatatacagacaatgcgttaataccagcacaaattagatatggcatattacatcacgtcgctatatcatataaaaatagagaatcagaaaatattaataatttaacttttataaaaaatatatattcccccttccgtgaactgaagttagttttatgacagatataactaaggaaatattcaattcagttataaaattacttcaatcaaataacaatttaactaatactgtaactgatatatacgacatcatacctaataaagtatcattaccatatatatatgtatatataagtaacttaaaaacattaaatacatttaacagtaacatgttaaaaatacaattatcatgtaaaatctactgctaccaacccaatacactatatgaaatattaaatttaatcaccaattcattagtgaatcacaaatctaatgtatcttattttgaatatgaagttactccagaatacagctacagtacaaatcagcacaatgaaattgcatatgcactattaaattttactattttagcaaaaaaaatttatgtcaatagaattacagattaaggactccaacaactctttttcatctttaaacaatataaaaagcttacgaattagcttacataacaaaaacgaatacattaaaaatatttcgttatcaggatggaaaactgctttggaaaactcaggaaatagatacgtaatattcaaggttcaaggtataatagattattcctctgcaaatcaacttttacaacaatattcttttaacaacgatattatagatcttaaaataatcatcaataaaaaagaagtaatatcagcaaaatgcattattgaattgtatgaaagatactatgagtcaagtaattttgacaatttcaatatggttttaataagctataaaaaagtaatttttaataattattaatataattaatatatatttaaaaacattaataattactaaaacaataatagtgttacaacaacaaaaattaatatataagataatagatagatgtaataactatcaaaaactttgtagaatagaaaaagaaatatctgctctattaaaaataacacaggataaatctttattgaatagcttttccacaataaaacaagtatcttcgaaagaatacttaaaaaaggaaggtaaacaagaagaaatacaggaagaaaatgcagaactagagaataatattagttatagaataaatatatcagacaataatgagaataatgaagagattgaaaatattaaaaatctcatcaagttaaaactcaatatccttatgtcagttattgcacatgaaatggatccagtacgacgtgcaggagaaactgctgcatcaaacagaaaagatgcaaaaaaatttggaagatcaacaaaagattcctcaagtttagcaatagtactacttaaaatgattttaaatcaagtaaaacttatattagaagtcgctactacaaatagtaaagatgaaaatcagaaaattgaaaatcaaaaagatatggatacagaacaaaaattacatctacctaatctaatccagaaagagaatcaacaaggtagaaacagataaaacgtattaatgtcatataattactaatataattaaaatatttaaaaaatatataaaaatataaatataacatctgaattaataaaaggtttatatagacatattaatattataatacctcatatatcaccaatatagaatatgcttttcccacataaattaaaaattaaagcaatataccatcatattgatatatctgataatattaatgaattattatatgcacacaaaaaattaattaaaataaaaaaatatctaaataagacaaaaaaaatatctcaaaatattaatgtatttaatataaaaaaaaatttatatcaagaatctaaaaaaaataattcagtaatctgtataaaaaaagaaattaagaaagaaataaagactctattaatgtcaaccatagctcatgaaatggacccaacacaacgagctggacaaaccataacttcaaacattagaggcgcaaaaaagtttggcagagataataaagctagaaaaaaaactagccatacacacaaatcaaaaagcatgtttttaaaattacttaactttttatttcaccttatcgtgccaatgccttcgtgcatattaaatgctaatctcgttatacaaaactccataacaaatagttcacaatatataacacacaataataattacaaaaaatttaaaactgcttataaaatacaaaaacacacagaacaatgcgtaaccaataaacttcagttacaactttaacttaagaatatactttataagtatagtatacttacacttaataataatacacaatattatagtcattataatattggagaattttatatgttaaaataatcatctttataaaatgtcttataatttcctagatttcctcaaattatgctttaaaacagtatcaccaaataatcaaataataaataattggcatctcaaaatcataacagacagactggaagctaccctcaatggaaaaatcaatcgtttaatcatcaacatgcctccaagatttatcaaatccatatgtgttagcatagcatggccatcatgggtccttggattaaaacctcaaaccagaattatagttgcaagttattctcaaatactcagtgaaaaattatctttagacaaccgatatatactacaatctgaatggtatcaaaaactattcccacatgtaatattatcaaaagaccaaaatactaaacaaaaatttcaaacaatacaaagaggttataggtttgcaacatcaataggaggaagtattacaggagaaggtggagatattttaattattgatgatccaatgaatcctatgcaagcactaagtaaaacttatagacaacgtgtatgccattggtttgaacaatcatttatgactagactaaatgatcgcaaaaacagcagtgttataatagtaatgcacagattacatacagatgatttaactgggtatttattatcaaaaaaaactcataacaaatggcatatactatcactcccaatggtagcagaaaaaaataatattttttactctgttacttcaccatggaaatttaaatatgggaaaaaaacaagaaatattttacatataagaaaagaaggagatcctctatataaaaaatatggaaggaaatatatagaagaattaaaatcagaactcgggtcatacacatttgcagcccaatatcaacaaaatcctattcttttatcaagtggcataataaaatataaatggattcaaagatatacttcttatgataatgaagatagcaatataactcaaagttgggataccgcatcttcttctaataacaaaagtgattacagtgtatgcacaacatggtcttatacaaacaactgcttcttcttgttagaaatatacaaagcaaaactagaatatcaatcattaaaacaagaaataataaatttagcaaatcactggaaacctaatgcaatacttatagaaaaaaaagcaagtggattacaaattattcaagaattaagtaatattagtacaatacctattataggtattattccaacaactaataaaacgaccaggttttataagattattcccatatttgaatctcgaaaaatatttttaccatatgattctccatggcttagtgattttgaacaagaattgctatcatttccaaatacacaaaatgatgatcaaatcgatagtatgacacaatacttacattggattaacaataacattacaaacaatgtcatcatcagagaaatataagttcacaattttcacaatataacctcttatgattaatcgttataattatcaacatctctatatatacagaaaaaaaatatgactaaaataataacatgataaatgcttatatagtaagcacactaaggagagaatatagcattaaaaatacacaccatgctgacattatactatacctattaactatagttgtttttaaggataatatatattgatgttattaatttagtaagttcattacgattgatcacaaaaggtggcataatatatatcacattattaataggacgtatccatatattcaattcaacccctttacttataatatcattcttattaattaatccactctctaactctattatcccagttgcaccttttaccctaatatcagtaacataacttaactgtctaaatatctctaattctgatattaattgattttcaattaaactcacattttgtattaaatcttgattttcaaaaagatctagtgaagcatttgctgcagcacaagctaaagcatttgccataaaagttggaccatgcataaaagcatcatctatattatctgataaaaatgcattataaacctcttctgtagttaaagttgcagccaatgtacaaaatccacctgttaatgcttttcctattaccataatatctggcacaatatctgcttgattacatccaaacatagttccaagtctaccaaaacctgttgccacttcatctgctataaataacatattattatctcgtgcaatctcacaaatcttttttacagtacttgcagaatgaattaacattccacctgctgcttgcaagattggctctaaaattatagcagcaacacggtcctttatagaatatactatatctgtaaaatccttaaattcttcttctgtctgcggtaagcgtaaaatgaattgtaaagggtgatattttttgaacttggtaccatgaattttctcaggatcagatattgacatacaccccattgtatctccatgatatccattaacaaaagatataaaactacacttatttgtatcccccaaattttggtaatattgaactgccattttcatagctacttcaacagcagtggatccagaatctgaaaagaaaactctactcattttctgctttggcgaaattttaacaagtcgagatgccaaaacataactttgttcatgtgctaatccagaaaacataacatgcgataacttagcaacttgattctgaactttttgaacaatatgcgggtgagaatatccatgacatacactccaccagctagatataccatcaagtaattttgtattatcctctaacgttatataacatccactagcagattttacccttaatggtaaaggcgagtttttcatttgcgcataaggcatccatatattttgatacccttcatcaaaccatgtacaaaaatccgcatacataactatttataacaaaggattacactacaaaaattatattataaaaaaatacaacctacaatcatacatatgtcaacaccattattaaacatacactaattattcattacaataaagataaacttacaggaatacagtcaatatcattgaccataaaactctagatttactctatataatattataaaaacataaatagggtaacatatacgtactatataaatcttcacacttatactgaaagtattagtatccaaatgtagtattaacatttattacattttctgccaaataatctacacaaacattataacctgcttagagtcaactagctttcataaaaacgtagacctatatcactttaactttgattacgatccatacaagtattagtatccaaatgtagtatcaatatttattacattttctgccaacaatctacacaaacattataacctactcagagtgagactagctttcataaaagcgtaggcctattattacttcaaccttgattatgacctatacaagtatttatgaaaacataaatagaacatttgtgaatgtctcacttacaaaatttttactgatcagttaaacacattaatgtagtatttccacctaaagctgtagtattaatactcactaccttttctgttaggaatctatgtaaatagtatggtccacctgctttagggccagtacctgataacccttgccctccaaaaggttgtactcctactactgctccgacttgattcctatttacataaacatttccaacattgacactatcaataataacatcaatattactttgtactctactctgtacagcaaatgttaaaccatatcctgtactattaatttcatctaaaattctgtgcaagtctccttttttatagcggattatatgtaatattggaccaaatacttccctctttaactgagatatactttgtatttcatatacacatggagcaaaaaaataacctttttcgcaatcttcccctaacttaactttatataacaattttgcttctcgtgacatcctatcttcatgagctatcaacatttcttgtgacgctttatctatcactggacctatatctgtttttaacaacataggatcacctacaactaaatcttccatagccccacaaatcatttcaatttgtttatctgctacttcctcttgtacaaacaacactcttaatgcagaacatctttgtccagcactcttaaacgctgatgttattacatcattcgtaacttgttctatcaacgcagaagtatcagttatcatagtatttaaaccaccagtttcagctatgaatggaataataccaccttctttttctgcaatagattgattaattattctagctgtctctgttgaaccagtaaatgctacaccacctattttttcattccttaacaatgcttcccctaattctttaccactacctaataacaagtgtagaacttcttttggtactccagcatcatgcaatagtttcactgtttcataagcaataatagaagtttgttcagcaggttttgcaagtacagtatttccagtaaccaatgctgcagcaataggaccaacaaatatcgctaatgggaaattccaaggagatatacacacaaatacacctctgctcctaaagtaaaggtaattatcttcccctacaggaccaggcaactttcttgattgttctaactcttgtcttccaagaactgcataataacgtaaaaagtcaacagcttcccttatctctgcaatagcatcagaaataaccttacctccctctctaatgagtaacattattaattttgccttattctcttctattaaattagctgctttttctaatatagcagcacgagtggaaactggaatattagaccaatctttaaatgcattataagccatatctaaagctgataatgcttgtgcagtatccgtaaataatacttccccaataatatcctcagaatttgttggagaaaatacctctataaaattaccatctaattcttttccacctataattggagctgctttgaatttacaagtttgataatttttcatttcttcattaaaatttgttaaagtaacagaatcagtaatatcaatacccatagaattaagcctctcaggaccaaatatatccttcggcaatggtatactaggatgaggtaaatattctaattctcttgctttttctaatggatcctctatcaactgttccaatgatacattactatcatttaactgattaataaacgaactatttgccccattttccaataacctcctaattaagtacggaagtaaatcttgataacttccaacaggagcataaaccctacatttaacatttgctgctaattcttgtgttacatactcatacaaattagcccccatgccatgcaatctttgaaattcaaatcctggatgatccttatttgccatctctaatatcgcagctaatgtgtaagcattatgtgtagcaaaacatggagaaaaagtatttggcttacttaaaattttgtttgcacacgctaaatatgaaacatcagtatatacttttcttgtaaacactggatagctgcttaaccccaattcttgagcattctttatttcataatcccaatatgcaccttttacaagccttaccatcattttatgatgggatcttactgatatatcttccacaaaatccaatactgaaaatgctctcttctgatatgcctgtacagccaatcctaaaccttcccatccattcaaactgctgtcaaaccgtaacttctcaagtatcattaacgatatttctagcctacttgcttcttctgcatcaacacacacacgaatattatgttcttttgccaatttacatatttgaagtaatttgtctactatctcatctaatactttatctatctgtgaaaactcatatctactatgcaatgcagatatttttactgatatctcatcataatctatcaaatttcctatctcattattaactttagactttcctatgctatccactgctgccatatattcagtaaaatacctttctgcatcttttcttgtttttgcagcttcccctaatatgtcaaatgaatacagttccccttctcttctattgttaagtgcttctgtgatatctcttccttttataaaatgctttcctaaaatacacattgcttgttgcactgcctttctaatgataggctcacccattgttttcaataaattatttatggtaccaaaccatctagtactatcattactatcctttaatacctttccacctataaacaaaccccaagttgctgcatttacaaacatcgatgaagaacttcctatgtgattactccacatactgttccctattttatcttttattaaatcatttattgtacaatcatctggtattcttaacaaagattctgctaaacacataagagctatgccttcttcatttgacaaaccatactcttgcataaaagcatctattatacctaaatttctatctactcttattctttcgattatttgttttgcaacactgtaaatcctaattttagaatcttgtgatatttctgttttttctgtcaaatatcttgtacaactattttcttctatacgatacaacatttgcatacgtctacgtatttcattcggcgtttgtaatgcacttatcatttctcatatctcccattaatacctaatatttgcaacatcagcatattagttaacattagaacatttaatcaaattcattatgaagttaataattaaacacactaataaaaatcaaatattttgtttatcataaatattaataatattctataaaaattcactactttattatttttcaaagagtcacatgaatttctaaaccaactattctaacagaatatataaacaagtaacacacacaataagacatcaatataaacactatataccatactttaaacacattactactataaaaaaacacaaacttttgcatatctttcataataataatattacactaaccttatttaagtaatggttatatgtataataacatttattcaatttaaatacacataacttacaaagtaatacaactaaaaatatacctgctatacttttaattctaaaaattcatgtataaatatactctataatacactttatttcattttaagaacactaaaattaatgtctagcacttattggatattatatagattattcaaacttatttagtcctttactttatagttttactaaaatataacatactataatatccgtctataatgtaaaaattttaatgtttatttagataactacctataatttatcctttatcatatttaatttcagtttaagaatacaaccctttactttccattataaataaagtagcatgcccatatttgagttaacgttagggtttacatgttcaatttgtcacaaaaaagatttctgattactggagcatctggtggtattggaaaagctataactaaaactttatcaaatgcaggagctatcctgtgtatttcaggtactaaagcacctgtattgcaggaaattgcagaacaatactcaagtgcaggtaacatatatactttaccttgtgatttaacaaacgatgaacagattaatagcttaattgacaatgcatgcaaggctatgtctggtattgatggcataatatgcaatgccggcattaccttagataaactcacattacgtacctctgatgaagactggcacaaagttatcaacacaaacttaaccacaacctttaaactaaaccgcaatgcatgtcgtgcaatgttaaaaaacaatcaaggaaggataattaacatatcttcaattatagcatttaccggcaatcctggacaagcaagttactcagcatccaaagctggtatgatagctatgagtaaatccatagcaaaagagtttgcaaaccgcaatataactgtaaattgtatagctccagggtttattgaaacaccaatgacagatgcattatcagaagaacaacgtaacaacattataacacatatcccaatgaagaggataggtacaccagaagaagtagctgctgcagttttatttttagccagcgatgaaagtaaatatattacaggccaaactttacacataaatggtggaatgttaatgtattaatgtggtacaatgctaatacactaatttataaagacacatgtttctttttaaaaaagcaacatataaaaccaaatattatatagcactttgtgctaatactatatactttggggtgttcttattcgcaatttttatacaattaatcagatttccttcaaagcttagcaataaagacctactgttaattaatgtgctaatggttttatcagcacgtattatgctatgtttattatcatcctatgaattaacatgcacacattacacaaatgataacgattccttattatattataaaaaagcagcatacgcagctgaagtaattagtactataatcgcaataataatacaagttattgcagtatctcaagtagcagcaggtaatttagagatagtatcaagtaaaaaaacaacgattcataccaaaggagctgtagactttgcttgtatattaatcaagttattaatagcatcaccactgctagtatattttaattatcgtagaatgaaagatgataaatgtgcagcatacaaaaaagatgcagaaattttattttatctttctataacatcactagttataagttttatagcattcatcggaaaaatcattaatgttttagaacaaacacaatcctttgcactcttcaatacagaaaatcacagcaataatggacctactaacttccctcttggcccaataattagaatatcatgtattgcagctagcataatcatattgacagtaatactcagtatagaatcatccattagctctaaaatgtcagataccacaatagaataccaaggactctctaatgctaatgaattgagtggctaaggagggattcgaacccgcgaccgagagattatgattctcctactctaccactgagctacttagcccctaggtaatcatataacacacgatctacataatttcaacataatttatatagtaattaattagtaaaataatgctttataactaaaatataaaaaatatcaaaatttataaatattaaaataactcaacactacctggttatacatatttacagtaaaaataccttatttctattacaactcatataaataaaaagctttaatgatagcatgcaaaattcttctacatccaagtaaatatatttacatagtaaaaaatatattgtatactcaaatttttactactttaaatcaagacacaaatcctaactcacataatagaaagatataacatgataaaaatcaaggcttcacgttatacaaaaatccatcttatagcaatagcaataattttatcattatggaatgtcttttttataataaagttaatatcaagtattccacaacatatcaaaaatcttatatttccatacactgcaatattatccatatcttcattattactctatggtattaatataatatacaatttaaatattatgttaaaataccatcaaggaaaaatagagctgcaaaaaaaatctctattctcttatttaggagtcataggagaagcaacaagtttactggcacttaacatcatatcaaccattgctattttaattttgccaatgaataaacccatgatcatagctgcctctatatttaatatactatcttcacttttcgttatagaatatgcctccatttttttaaatacagacattaaaaaccacaaacagttaaaaaatacaaataagtccacaaaatatacaacatggtcaataataaactggtctgcagcattaatcatatcaatagcaaatgtaagttttacatttactggttattttataaaacacaatgccaatgatatttttaaaattatattatttacagtatacatatcaattattacttctctaatctttatgagaaatatgcgagaaaatgatccctcaatattactaaatgcacaggtagaacctacaagatttaacacagatgaagaaagggaacatcttctgaaacatgaagaaggaatctcacactacagtaggtaaactcatatcagatctacacagtaaatatttatgtttgcaatcacaatgcatatgcatatccttacctttctagcaaaattactgtatgtattattaattactgataaacaaaatatatattaatgttgtaaaatataaatgctcaatattgataagcagtatacttatattataatgctaaaatatttataatctttaattaatcattaagaacttaaatcaagttcacatacaactggagcatggtcagaaggtgtatccaatcctctaagtttatcatgaataacacaagacaatagcttatctgtagcttgtggtgataataacaagttatctattcttaaacccctattttgctgccatgcacctgctttataattccaccaactaaatttcttttcatagtcattcaatacacgaaaagaatctgtaaaccctaaattcaaaatagatcgaaacttttctctttcagacttatgaaaacataatttaccatccataacttcaggatcatagacatctataggataaggtgctacattataatcgccacctaatattaaaatttcttcttttttaagtaaagataatgcatgttctcttaattgatcaaaaaacccaagtttatattgaaaagcatcagaatcaatactttgtccattaggaacatatatactagcaatacgaattttaatattatgatgtagaactacacactccaaataacgagactcatcacaattataaataaaattctctgaacttaattcgtaacataacttagatttgtaatcagatgaaaaaatacttgtaaccaattccccaactataggataccttgttataatggctactccattcctagccttctgcccatgtacatagcacttatatcctaatgattccacatcaaaaaaaggaaactgttcatctgtacactttatttcttgcaacaacgctatatcaatagcactattaattagccaattacataaatgatccaaccttttcctaatagagttgacattccatgtagctatttttaaagtcattgtgatctctaaaaactacttatcaaattaagttaaatacttaccattaatatcaacaaatctatgagttaaatcacaggtccacacagttgcatcgaaattaccagcattaatatcaacttcgatataaatattttgctcactttttacgtattgattaacagaagctttatcataagtagaactaatttcaccatttactaatattacatgggttcctatttttaatgatacttcatttttattaaagggttccccagctttacctatagccatcattattctaccccaattagcatctccacctgctatagcagttttgacaagcaaagaatttgctactgaaaaacctaattttctagcagcatctactgacgtagcatttttaatattaattgcaataaatttcgtgaccccttctccatcttttacaattaaatgtgccatttccactagcatatcttttaaagcaactttaaagtcatcaagagcttgatcatcaacggaacatacttgcttatgtttagcaagatttgtcgcaaatattaaaactgaatcactagtagatgtatcaccatcaacagtaatattattaaaagatacattaacatactctttcaacaatttctgtaatacatctgacttaatgttagcattggtaaaaacatacgctaacattgttgccatatttggagcaaccatacctgaacctttacatatcccatttatggtaactttttcaccacaaattgatacctcctttgtgaccatctttacaaaggtatcagttgtagtaatactatcagcagcatcttcccaagagcttttaatactacccaacataggatctagtattacagatttaattttttcaaccggcaaaggaatacctataattcctgtagaacaaaaataaacttcttcagtagaacaatcaaacctttctgcacacaaccttgtaatttcttcaacggctttataccctccaacacctacagcaacattggagttaccagaatttacaattaaaacccttgccttaccatgaggaagtatcttcctacaatgttcaacattgctactcgctgtataagatgttgtaaataccccacctacactagtgttatctggcatcttaactattaggagatcaagttcatctacaatgtttttaataccacaagcaaaagaatacaactcaactccatcaacttcaggcataacaggaaaattagttggagcaagaggagaaataagaaatctaattggattatttgaaaaatttttgaccattactactaccaattaatgcttcttaagttatataaagtatatgcatataatgcaagaaagttattgaaaaaaattactaaaacttgcttgtaatattaaactttaaataagcaacttctaaaatcaacttcaacattatcattgcgttttttgtatcaaaaactaatctcaataacatgtatttcaagcacagtaagatctaaattacagtatgaccttaaaatcaacaaatacagtatgagaattcaactgaaaatcctgaaaatgatataccacagtattaccatcttcatcatagatcttatttgtgtcatatttccaataatttttcagatagtcatatccgatacataaattcatttttttactataaagataacataacccaacttcgctttggatgctcataccataatgagtcgcaacattacttctaaatccctgataattcaataaaccagcaataccaactccataacttaagtatactatcaacttattattaataacataatcatatccacaattaataagagtagtaacactattgattttaaatatatcttctattttcgatatataaaccttcttatcaataattctctgtaatatatcaattaaatctattttttcaaaatactctaacttttgtatagcaggttttatatttgcatatcttactttaacttcatagaaaaaattattacttaattgatatccagctgcagtattaatatctatgttaaatcgtttataacccatatattctgacttaaagctatcagaataatttccaacaagattatagcctcctttgagataaaaatgatttgctaaagcatcaaaattaaatgtaacaactgcaaaatatacaataacacatatataatttttcataaagagtaaaaatattaactatatatttgatatataattctctattatcaagtcaacataaaaatcattatgataatttaaacattatcgataaacatataaacaactataccattattcccttactatatacatcacttgtaactgcatgctacctatatattagacatattatcaataagataaataactttcttaagaattagatttaatatatacttacgtattatttatgtgttcccattttaaacataaaaatatacaacgctaaaaattccataataataaataaaaatattctagtgaattgataaaatataataataaagaagttcaatatattataaacaatacttagtacaaatgaataatactaaaaaacaaactctaaaccaaacataagaccgtaagatcctaaaatatagcaacgtttaaagttaatattatctttaggtttcatataaccaataaaatatctatatccaccatacataataatattatttaataactgatactttattccaacaatgctttgcatcattaaattacttttaagatctaaagtttcagtatttttcaaaagtttaccaatgaaattatggagatcaacacctgctccaaaaaaaaatgtaaagtctcttatactaaaaaaattaccaacatcatagtacaaattaaagaaaactttgtatttattattattccaatacaacatctttttttgtaagaccttttccctatcttcatcaactacttctttattattatctatttttttcttagttatatacataaactctagatcagttctaaaattatttaaagaggcactaggacatatataacctaatgtcaaccctgcattataaccagtcacattatttacattaaaatcaaaatctaaatatccatctccagttttaaattccagtatttttttatcatacccataagatccaccaacataaaacttgctaacagaatcacttaccatactttttgcaaatactttactgtgtgttaaacaaattaatactaagagtataatctgtagatacaagatagctttcattaatataactacattcttaccaataaattatgtataatataaaatattatttgcattgtaatttaatcaacatttaataagagatcaaatcttatattattgcactattactaatcaatcagtaattaagttgtcaccccaatcaaaatacaataaaatctagtctttaattaatatttccattatctatgaaaaaaatagtattagcttattcagggggattagatacctcagttatattaaaatggctccaagaaaattataattgtgaagtagtagtatttactgcagatttaggtcaaaatgatgatatgtctgcaataagacaaaaggcagctgcatcaaatgtaaaagaaatttttatagaagacttaaaagaagaatttgtaaaagatttcgtattccccatgtttagagcaaatactgtatatgaaggatattacttattgggaacatctatagcaaggccattaatagctaaacgacaaattgaaatagctcaccttacaggagcagatgctgtagcacatggagcaactggaaaaggaaatgaccagattagatttgaatttggatattattcatgcgatccaaatataaaggtaatagcaccttggcgtcagtgggaattgacttcaagaaatagtttaatagaatatgcaaaaaagcatggtattgatgttcctttagataaagcaagtgaaccaccatattctatagatgcaaacctattacatacctcatacgaaggcaaatctttagaagatccatatattgaacctgattatacaatgctctccaaatcagtaattccagaattagctagtgatactccagaatatatagaaatttcctttaaaaacggagatccacatgcaataaataatgtacccctttcacctgcaaatctattacaacaattgaatataataggtggtagacatggtataggaattattgacatagtagaaaatcgctatataggcataaaatcaagaggagtatacgaaactcctggaggaacaattcttttacacgcacaccgtgctatagaaagtataactttagacagagaagcagcacaccttaaggatgaaataatgccaagatatgctaaactaatatataatggatattggtggactactgaaagaaagatgttacaagcacttattgataaatcacaagacaaagtaaatggagtagtacgcttaaaattatacaaaggatctgttatggttgtaggacgaacatcagaaaatagcttatattcacataacctagcaagctttgactcatcaggaaattataatcatacagacgcagaaggatttattaaaataaattctctaagattaagaaatagctaacattttactttaatattgtacctttaaaataacaatattcatcttaagtagcattaagtccaaatcaaagtattatcactaatatatttaccctaagatttggacttattcttataatacgaaatgaaatttgcactattagcaatgtcacacatttcactactgcaaattaattacaatagaaaaattgctatactaataaaactgttatttaaatttaattaatatcactaactcaaatcaacctttcacaattagtaaaagtaccgctaaataacatttacctgcttgctaaataatgaaaataggaaaattataattaacaacacctattattatctaattctcccctattcacattaataggatctacttctaataatgttgcacacaattcttcacatccttcttgaccaagtaatgttgctgtttctgactctagtgtattactggatttattcgctacaggatcatgacttggtacaaaaacttgtgataggaaaatagaggttaaaataactgcatacccaataaagagagcagctttcaaaagcatagcaagatcatgattagcagaaaagtctaaaacctcatgtaataacgtttcatataaaagattataaattcccaacgaaacaaagattacactattcaataatgaccacacagcatgcaaccttattctaacactattgcactgttttgatctagcattgccttcaatacttttcatcaaaagtatagacccatatgttacagaaaatagtgatgctacaatattaaaaagacgaagaggaagagctatagaactaaaaggtaataagtgacttcctaaaattagtaatatagaagctatacctaaaaatcccgtagactcaccaataaaaccacatgctacagctatttgtttcctagcatcacttaatgcactattgtccttctttgattgttccgacagctctcgccttacattaataatattcaatatattacatgtaatattaataaattgtgagataaatcacatagctgcaactattagcaaaaggtaacttgctaaaaattgtatattattagatccatacaacatgataaaaaatgcactagtcaataatattaagtaggaaactgacaatacaatatatgccatttgccacttatgaattttacgcttattaaacaacctattttttttatgactattatctctcataaaccctctaataacacacatatatattaatcatgagggtacagaactattttgtaaagtaaatatttttattattattttaatataattttaacgtaagagtagaaactttatataataatcagcgcataaataccttatggcaagtacctcaaaactgtcacctactgacggcaatacttcacctacacatagtaactttctatgatattacgaaacaaacaacaactcacagatttcatgaaaaagttgcggggaccggatttgaaccgagcgacctacaggttatgagcctgtcgagctaccagactgctctaccccgcatattaatatgccataaatttcagatcaaatatttactatactaaattatttgctctggcaagaactttttttcacatcagcaccttgacttgtactaggagatactgcttgagcacctatatcttcagatgtaataggaggtagtccctgaacaatatctgtaatttcctcacttaattcttgtagctgttcttctgaagccttatgttgtccttcacccttatcaaatattccactaagaaataatgattcacttgaagatgacaatcctctagaagataacgatgataaaccactgctgcttaaactcgatatttcctccacagaggaagatacagatacggtatcggtctcaaaaccactctccttcgctgatgcacctagagatacagtaggactcattgttattgtattcagttcaggagaataagatggaagtctatgcaacacagatttttgcgacttactgctatcaacaccttcttctacaccatctaatgttttataaacaggaacactaggaataaactcctgaaacggagatgatccctgaacctgttcactctgtatttccttttctgataatgattcactactactagagactccctgaaactttccactttgtatcccctcttgtaatgatttaggactactaaaatcgggtccatgtagaccatgaactgcagcttttgcttcatattttagtagggtcttgtatacagaacgtcctaagaccttatctaatattgttttaggctttttaagatgactttccccttcaacacatcctgataataatttaccatccaaactaggtatcgttaatgtgtcgcaactacatgctttaatcaattttttggaatatgtactatcccctgatacagcataatgcacaggagttttcccttcgtcatttcgaacattaactgtacttgacaaagattctttatccaaaccatttaacattaaatcaactacttcattcaaaccttgctgaatggtctgtaagccttcagcaccaggtctcagagctaaatgcaatgctgtattaccgtacaaattttgcacacctattacagcacttaaatcccttttatcacaaccttctaatattattcgcgcacatttaccatcataattcttcagtgcacaatgcaaaggtgtatcaccattgttatttggtgtacatgctaaagcctctagcacatctttatttaaattacttactaataattttactaaatctggattacctgaattaacagctacatgtaataacgtctctcctgcatcattttttgctcccgcaatctttgagaaatcttttttgtccaaagcagatatcatagcagatgctatcttagtaccagataacttaagagctaaatgcagcggtgtatcaccattactattttgttttgagagaatatccctggcagttcttccacctttagatattagcgtttttacacccttttcagcaaaacctttttcttgatggttaacaagcatatgacatgctgtattaccatctcttcctacggcagtagcattacatcctttagaagataacaattccagcataacaagatcagtgttttccacagcaatcattaacaaactatttttataatgaatactgttctcatcagagactttttgattaatatctccaccactagcaaccagtttcttaacagcatgagtattaccagacactacagcagaaactaatggagatgctttaccttctacattaatcctttcaccttgttccagtaataaatctaataatttgttatacccagaatttatacacttttgtaaaagtatatttttatcctcactttgaccaatttttgcaccactatttaataaaagcttaactataggaacaagttttttttcattttgtcctgaatatatagcactagatatcacagaacggccgttattatccacagtattaacatctgctccagcattacatagagcttttacagttttcaaatctcctttttccatcgcagaatgcgcagacgttttaccatcagcatttctaacattaagatcaatagaaggatgggacaataatctcttaataagactatggttacctctattaattgcatattgcaacacagtattttgatcgggtcccatagtttgattaacattcacactttcatgttcaaccatcctttttattatactaccatcacctcggatacatgctagatgtaatggagtaagtgtactatcactctgagcattaacttcttctcctgaagcgttctcaataatcaattttacagttttaacatctgcaaataaagcagccatatgaacaggattgaatccattaggggacgattgtctgaggatatctggagatttttttaaaaataaattaagcaattgtagattattcgctttaacagcagcatgcactggagaagtaggaaaattttgtgaattcagataaccatataagtctccacttacacctgataatatactctgcgaaccaaaaccagacacatttaacctaggcccacttccttctcttattaataattcttgcaaaacttgtttcccatggtgcttttttatagattgccttacggtttcaaatgccttggtaccttcaactttacaagcaatatgcaaaggtgtatcaccttgcaaatcttcacataataatgatgcagcagaacttttaacaccttgaacacgtcctttaactgaacataaattttttatcgattttatatcattaccagcaacagcataatgtaaaggtgtactataattcttatcacgtacagcacaatctacaccattttgtaataacatcacagataacccttttgaattaccgctgattgccgcacaatgcaatggagtacgtccatttacatcttgtgtattaactgcactagcttgaggagactcagcttttgtatttctgattacatatgatagcacctcagaagaagcagcttcagcagcataatgtataggcatcctaccagtaggatgatctataagattaaaatccataccacattcattagcaacctgtatgttccctatagaacagccagggttctgaaccataacatgcaatggggattgatttccaaaatttctaatattaattatattactatttgtcttagatatacaattatccaatacttgaccattacaatttttagcagcatggtgcaatggtaaatttccatcagcatcctgaatattataaccatcaagaccactctcgccgaatgaattctctacactttctatagcgttaatgatccttggatcaacattatatgcataagctaaatgcagtaatgtcattacatttctaccttcacggacaggattattaggaatatcaacttgcactggctcattaattagttcagatatcccttccttatcattttttaaaatactaacaatttcttctagatctggctcaggtaaatttccttcagattgtactattttatcacaaatatgacgcattaacccatcagttactagaaatttaggatctatctcttcatcatgaataactgcatccctaacaccttcccacataacatcgtcaaactccatagcgtacgaaccatcattaaagccatatggtccattcactaactgtctgtcccctatactaggaccttgatatcccgcttgatctaactgttgaccaccttgaccaagtccttggaagtcagcaggatcttgatatatatcttcttcaagttcttcacctgcttcttgaggtacagggttttcctgaattccatctgcacctgcaccttgtgaaacttgatcaagactcgcatatggatcttcttccatttcttcctgatgcccgggtattccctgatatataggatcttcctgaggctcaacttcacccacattgtttcttggcggaagtggaggagcaatttcttcctcttcttcaacagaaggatcttcttctaatacttgagtaggagcaggtctttgacctttaggtaaaggtaccgcatacaatggatcttcttcaactgcttcctgaagctcagctacatcccctcttggcggaagtggaggagcaatttcttcttcttcaacagaaggatcttcttctaatacttgagtaggagtaggtctctgatctttaggtaaaggtaccgcatacaaaccttcttctacagtttctcctgtttcttgctgagaaggcaaatcagcaacatctaatccaccaacagcaccttcttctactggttgggctagcggtggttgaccttcaacatgttgttgatcttctccaccaggctgaggattaacctgatctgaactttgaatattatcctcttgcgaattaggattttgttgtaaattatcttgttttggatctgccataaaaacttcctatacaaactatttagattatccttgcaaattattacaaataataaatttccaaccatttaaacaatcaacataaggctatgcatatttaaatacattaaagtggtttcaataatccgcagtcataggatatcaacaatacttaaaaaaataattaatatagacttgtatgacatctatcccacgatcaatactactaaaataccaatatttcatacgttgtatcaaagatttttctatgctcttgaatagcaaaacgatctgtcatgcctaagataaaatcacaaatacacaattgatcgatctattaaattagcatccatcgcttttacaccccaatcagaaggtaaaatctgtggatcatcataaaaaacttgaaataattccttggatatcaacaataattaaaaaaataattaatatagacttgtatgataatactacgatcaatgctactaaaatactaacatttcatacgttgtatcaaagatttttctatgctcttgaatagcaaaacgatctgtcatgcctgagataaaatcacaaatacataattgatcgatctattaaattagcatccatcgcttttacaccccaatcagaaggtaaaatctgtggatcattataaaaaacttgaaataattctttgaatatcaacaatacttaaaaaaataattaatatagatttgtataacatctatactacgatcaatactactaaaataccaacatctcgtacgttgtatcaaagatttttctatgctcttgaatagcaaaacgatctgtcatgcctgagataaaatcacaaattacaattgatcgatctattaaattagcatccattgctttcacaccccaatcagaaggtaaaatctgtggatcatcataaaaaacttgaaataattcttttattatacgctttactttattttttacccttttcactttatagtagttgtataatttagttctaagaaagttttgtaagcctattttatactgattcatttcttcagaaaaatgtacaaatactttacctaacttcctaatatcatcatgagaacgtatatcatactctttaatattgtttgtaacctgagatattatatccattaacataatatcaacagttcttcttagaaactcatgcacaattcgattatcagatacacttaatccagagttatcatctattactttctttaagatgtccccaatcaatggtaattctaataattcctctataaccaaaatttttgctcttattccatcatcaatatcatgcatattataagctatatcatcagagatagatgcaatttgagcttcagcactagaaaaattgtcaaggtctaacttataatatgaatcataatctaacataaacttatgtatttttttattagaattaattcgattttcccctgtaataggaccattatgtttagctactccttccaatgtttcccaagtaaggttcatgccatcaaattttatatatcttttttctaaaaatgttaatatcctcagagcctgaatattatgatcaaatcctaaatgatgcatagtcatctcatttaaagcatcttctcctgcatgcccaaatggaggatgacccaaatcatgtgctaaagatatagcttctgttaaatcttcattaaatctcagctttctacttaatgaccttgctatttgagcaacttcaagactatgagttagtcttgttctataataatcattttcataattaataaatacttgtgttttatactgtaatttacggaatgcacccgaatatataatgcggtcacgatccctttgataacagtcgcaatattggtcttcctcttcatgaaatattctacctcttgtttcagtaggattacatgcatattttactagatctaacatagttataatttgacacaaataaaaagtatgatatactcactcgttagtttttaattcggtattgcatatatgtcaaacttaaagagtgcagacttaacccttacagaaaatgctgttaataaaattaaacatttaattgatcaagaagaagatgcagattctcttttatgcctatccgtttctggtggtggatgttcaggatttcagtataacttcaacatttgcaatataaatacattacttgctgatgacgaagatgatgaagacgacgattatgactttcttgacgatgatgatgaagaatacgatgacgaagatgagttagagggaggaagcagtgcaaagtttaccgtttttgatgaagagaccggaaagcctctattactaatagatcaagcatctaataatcttttaaagcactctataatagattatgttgaagatattaatgggtcaagatttataatcaacaacccaattgcaaaatctaagtgtggatgtggtaatagtttctctatataagtcatggtataactttgaaaaaatattactctttcataaggcttttttcaactgtatttcttgccttagttgtagctctattgctgcgggtctttttatttgaaccattccacataccttccggttcaatgaaaagtacattgttagtaggtgactatatatttatcagtaagtatagctatggttatagcaagcattctattcccttttcactaccaataataaaaggtcgcattttttctaaactaccaaaagctggtgatgttgttgtatttcgtccacctaaagagatgaatcttcattatatcaaaagagtcattggagtacctggagataaaatacagctcattgatgggtttttgtatattaatggagaaaaaatgaagtatgaaaagctgggtgattttgttgatgatgacggaaaggtaattagccgctattcagaaactctatataatggaaatactcatgaaatattagacgaagttccaggtagcccacttgacaacactcctgtatatcatgtacctgaagggtatgtttttgtactaggagataatagggataattcccgagatagcaggtttattacagatgttggatacatccctcttgaaaacatcgtaggtaaagctcatgtggtagcactgtcatttaaaaagtctgatactgttttaccttttgcaataaggttagatagaatatggcatactattaattaggcctatttatgatttataagaaaaatttttcaaagttatcacctatcacaaatttgatacgtagtgctcttcttaactgtaggggtatgtacattactttacgttatatgtttaagccaaaagttactttaaactatccattagaaaaaggtcccttaagtacaaggtttagaggagaacatgcattacgcaagtataaaaatggagaagaacgttgtatagcatgcaaattgtgtgaagctatatgtccagctcaagcaatcacaattgaagctcaagaacgagatgatggtagtcgccgtacagtacgctatgatatagacatgacaaaatgcatatattgcggtttctgccaagaagcatgccctgtagatgcaatagtagaaggtccaaattttgaatatgcaacagaaacaagagaggagcttatgtacaacaaaagtaaattactccataatggacaaatatgggaagaagccattgatttaaggatcaaaaagaatagccaattttattaataaaatcaaatttttaagtatatataatcatcttctacattaaaaattctgtcaattattacgatatacttttaaaatcagttataacgttttatatttttttgtcattagtgtatcatacaagtaaatcatttctaatttttagaactcttttataatttaaatacacactattcaataactcaattatattttgatcatgacaagatgatataatacttatatcagacttaattttcttacgtttacaatttaataggtctagtaattctttttctatacactggagatctttcactgttgaaaaatctaattgttttaaatactcaatttgtatatcaagaatatttactatctgtgattttatttcaattatatcattcaatataaacactaaaaccccctaaatatggatgcattccatattcctatagaagattagttactataaatctctaccttttttcttaataataaaataccaagatacttagttaataaaaactcaacctttatcaaatatccaaaattatatgatttttaaatacttaacctaaactagaccatattcttactagcacgggaagcacgtttacgttcattaggatctaaatattttttacgcaaacggatagatttaggtgtacattcaactaattcatcatcattaataaatgctatcatttcttctaaagtcattacttttggtggaactaacctaactgcttcatctgaacctgctgctcttatattagttaattgtttaccctttaatacattaacatcaatatcattttcacgattatgaagcccaacaatcattccacaatatactttatcttgaggtttaacaaacataataccccgatcttgcaaattaaatattgcataagctactgcatcacctttatcagtagaaataagaactccattatttctagtaggaatattacctttatgtggagcataactatggaataaccggttcataattccagtaccatgagagtctgttaaaaattctccctgataccctataagaccacgtgaaggaactaaaaatatcattctcactctatcttttccagatggacgtaaatctcgcatatcacctttacggaaacttaatttttccataatcacaccgctgtatgcttcatctacatctataacaacttcttctataggttctaaaacttgaccttgatcatctttacgtaataaaacacgaggtctagatacagatagttcaaaaccttcccttctcatagtctcaattaacactccaagctgtagttctcctcttccaccaacctcatatgcatcaccctgctctgtctctttaactgtaattgcaacgtttgtttcagcttcagctacaaggcgtgctttaataacagtcgatgtcaattttactccttccgtaccagcaaatggcgagtcattcacactaatagttactgccatagttggaggatcaacaggtgttgatgtaataggaaaattaatagaactatcaagaatactatcagatacagaagccttctcaagacctgcaacagcaataatatccccagcttttgcctctttaattgggatacgctttacccctgaaaatgccaaaagctttgtaagtttaccatattcaacaacttcaccagataaattcaatactttaacactgtcattaacccgtattgtacctgtatatatttttcccgttaatattctacctaaaaatttgtccgactctaataaagtcaacaacatagtaaatggtgcattagcatcataagaaacaggctttacatattcaacaatcgcttcaaataatggtactaaactttccctattatcagacaaatttttaacacaccatccatttcttcctgatgcatataatattggaaaatccaattgctcactagtagcatccagattgataaataactcatacacttcatctagtacttcatctactctactatctggcctatcaactttatttataatcactattggtaataatccagctttcaatgcttttgataagacaaacttagtctgaggcataggaccctctgacgcatcaacaagcagtaacactccatctgccattgacaatactctttctacctctccaccaaaatccgcatgtcctggagtatcaattatattaattttcttaccttgccaaataacagatgtacactttgctaaaatggtaataccacgttcacgttccaaatcattattatccatcaccctttcagctacatcttgattttctctaaatgtaccactctgttttaacataccatctaatagcgttgttttcccatgatcaacatgagcaataattgctaaattacatatcgactgataatcaccttgtgacaacataatatctcttaaactttaaaactctatatattaacttatagcacacatgttactaatcaacaaacactgatttaacaattattgatacctatcttacttaaataaaaactatagtactacattttagaaatgaaacataatataccaacaaaagcatctcataacatataactaatagacacacatgttgttatacacacaactttccatattgaaattacactttttcattttatcatctaataaaaataaaactactaatacgagtaacctttatctctaaattgcaataaaattaatttaccatgataactaaaatcatgtagaatgttatcttgctatattactttataaaacctataccaagaatcatctcaacaacaacaaactttgacatgtcttgatataggtagggttttttccaaaaaaatacaaggataccattgatattatacaaaatcatcacctaaaagctttataacttaacataataccattcttagtattattttacctaacagaaatatcttctacacttcttctcttaatttacctacaccacctttgtagatatctgtgatcaaactcattagatattaacatcctatatatacactatttattcatgtgactttgtataatattaaggtcacgttcaattccagcaacagaaatatccattaactctgtcattacttcagcacgcactctatatcgctgctctctctcttctctttcttgtgccctagcatgttcttcctctacaaaaccctgactgtttactgcgctttgaagatcataatcccatgctaatacttgacgcatctctggtctttgtcttcgggtatcatcctgttttgtacttcttggaatacaactttgacaacatgaagaatcattttgtgtattatcctgttttgtgcttcttggaatacaactttgacaacatgaagaatcatcaggtttttgtttggatactacaaagtctaaatctaatcctgaaaaatattccaagtcacggcattcattaaatgcacaatcataaggacctccaggtattctacctaatacaaggtctccataataaccaaggttaccacaagtaaacactttaccatctcggtcaacattagaagatacatcttgcctaaattcatcaattttagattcgctaactacaaggtatatatggaaatgtgcagaacgagtgaatggccccagattccgtttacctgtcaaacgacgtaattctggatcatctcttaaaatataagctggtatattaccctttaataaaaatatagtgtctcccgtgttcggaataggtaatttctcatccttatgagtttgagtaacacgcactagtgtcttacctctaggtccagtattacctattacataacacgactttagatttactgcacatattgaaagtttattacataaactcagattataagtcgtccttcctctaatatactgtctgtttagcatatacataaccactataatttaataatattattcctatatatcatattaatattacaaaaactctgcaataccttaaattacggataatattgctatagaatatcacacaacaatatattataaattatagaatactatattattatgatataaacacagttttatgaaaaatcatagaccgtacacccatgtacgtcaaacaattccgtatccaagaaattacagcagttttatattactatgatagatcttatacatataaagcaatatacatttctgtcatgctccctgtactattaattgaccatattatataacttaacatttgaaacatggattaccacctcctgtaggaaaccagagaatcccaggttttctataaagttagaaatattttttcaatattacttatgcttttcaggaaactgagattcaatgccttcaatagaaagacccattaattgtgtcatgacttcggctgctagtttatccttatcttgtccactaccagaactctcagatactacatctgcacctgatacttcttgttgtgctgcagcttgttctacttcagcctgttctacttcaaaatatttcgtaaaatcttcttcagataaaaattttacattacttaaaccaccaatttgtactaagtctctttcttcactaaaatcttcatcatattttgtaccatgacctctaacgattacaatcccaccgtaattaccaagacctacaaaattttttcgacatagtgacatattacttgccgcatgtaacagaaacggatcaaggtttttactatgcaccatatagtatacacttatgttataataagcagttaatataccaggttcacccagtaaacctcttaattcttcatcatcttctactgcagcagccggtaacctacatctaagtaaaaataggttactccttggacctggaagaggtaactttcttcttcgatgagttttagtactctgcactattaactgacctttagaatcagtaatacctattggataaactgcttgtaactgtacacaatcaagagttaataacttttcctgtaacagggtattaaattttattttatcagttaaacatatttcacctaacatacaacataaaattgtctacataatatatttctatattaacttttattatgataaacttcaattaaaaattgtattcattaatataaaaatattctaaccgctgaatatggatttttataagatttattatatttaataaatcagcaaataaaataatttacacaatcccatagtattcaaaatccatttgttacctacactaacacagaatattacaactaatatttattatttatatacagacaatagtatgaaaactcctaccaaatgcagaatcataacatcaacaacttgaatgacgaagtaagacaagtactgtttttattcatattaatcatacgatctttttagttcaacgctgcacaccaggactactacttacattagatataacaacatcttctaattgtgccactactctctccaaacgccgatttgactgatttgattgttgttgcaatacactttgttcttcattactccccgtctctaaatctacaaaatccgagctgttaacaaattctcgctcttcagtcttataacaacaacttcctacactttttgagactaaaaaggttgcatctaaccctacaaaagttgctaaatcttttgtttcatcaaaaacattactatatggtccaccatgtacatgacccaatataatattaccataacaaccaagattattataagatcgcccatttcctaatgatgtttctagaaacactcgagcataaaaccgatttaccctgttttctggtactagaaggtaacactgaaattttagactacgagtaaacattccaaaactacttcccagcaaaccacgcaactctggattgtttaatacttgatcttttgataaactaccttttagtaaaaataaaacagatcctgaagctggaacatgtttataaagtggatctttatgagtcttagaggcatgcactaacattcgctcaccttcagtattacctattacgtaagctgacttcaatcttattccgtaacaagatgacaatgcactacataaagctttattataagtttttctgttttgtacatttctattattaaacacatttaacctattacaattttaacattcccaatatgttatcgcataatagaagcttttcaattattagtagttacgagcatgctaaatacaatccattaatgtaatatattttaaccatgagatcaaaacggcttcatattaacttttataatggattaaggacaaatacagattgaaaatagtaacattttactaaccaataaaaaaaactttaagacaaatctcaactacatactaaaaatacacttaggcaagcataacgaaaacaactagcattactactttagatatcgtctttaagatttgactattttaaaccacataacttgtcatcctactgatcatattaagacaaacctcaactaccatatttaaaaatatacttaggcaagcataacgaaaataactagcattaccattttagatatcgcctttaagacttggctattttagaccacataactcatcatctctactgatcatattttcaaattgaacagagatattctttaaatatgtaatcacttcatctttactaatcatagcttcaagttgtatagaaagatcttctaaatattgaatcatgttatcttttgactcacattcacgactttttagtatccgatgtttagattgctgaaaactaggtaccactcttaaagctccacctactgcacctaaggatgaatcatcactattatctactgattctattaacttctgtacttttttacgtgacaataaacctttctcttcttccaaaagaaaatctgcatttaactgcgcaatattctttaaggcttgatactcattaaaatgtttatcactatctcctccacgtactctaacaaatacaagtttaccataagaacaaaaattaaaaacatccttatatccatcatactctactacttgtttccatatattgtaaaaaaaatctgaaaaacattctgccttagccataaagtataaattgagcttaacatagcgcttcaatattacaggaccacctacaagagacctaagctctcgatcttgcattactacactacgtggtattctacactttattaagaaaagattctttcctagatctacacccacacctaaagaaagattttcttgagttttagtaactctaactaataatttacctctagggccattagtaccaattaaataacactctttgacttgaagctttaaaagagaggttatcttagcacatagaacactattacatgatataagatcttctaaggatttattactaaacatatactaccaccaaacttacctaattttattatgatagtatgtattttttaattaaaataaacaaattatacaaataaagatgatgatttttacacaaacttatactgtaatttttctgtctctaaacttttacactaaatatagttaactactacaacttacaatgctttcattatagtgtattacctgaaactattaatattgaatacagttcattatcctatatctcaaaaatatttataaatatgatttcatctataaaaagcaccattataacattacaaaatcatgttttaccgtccttactgatcaccttctcaagctcaacagaaatattctgtaataccgtaattacttcatttaccattggtggaacttctttcttctttttcggatgtttggctgctataccttcaccaccaactgcacctaattttgactcatcttgcgtaaatattccaccgagtaaatcatctgttggaacttctttcatttccagatgtttgcctactacactttcaccaccaactgcacctaattttgactcaccttgcgtaaatattccaccgagtaaatcatctgttggaacttctttcatttccagatgtttgcctactataccttcaccaccaactgcacctaattctgacccatctatagtagatcgtactatcacttttttcttacttgacagtaaacctttgatttcttgttgtacagtaaaatttgcttttaattgggctacatttgctaaagcttcaaactcatcaaaatctttatcattcgatgcagtacgtactctagcatatacaaactttccataaccacaaaaatttgcaaaacgtttatactttctatagtgtgttttccgccatacattaagaaagaagtctgtagcagatccatcgttaactaaaaagtacatatttacttcaaaagtactagaaaatttggcaataggattaatcgtattccttaacggttcttcctccattacaaaactacttggcattctacacttcattaaaatcagcttatttcctgactgtgtcccaaaaggtatttgctcttgatctacatgagttttagttaccctaacatttaactcaccattagaatcagtcgtacctatgacaaaacatcctgaaacttcaataaatggcaaacttgttacttttttacataataaatcattatattttttttgatcttccaaagacattttactaaacatatactaatctcaatataatacttttacttattatgaattataattaatttatatataaattataaaagcacatctaatatcaagtcaagtatatcaaaacatataatacaacaaaaaattgttattcttacttagaaaccaacgcaaattaatactataataataaaaaatactaatatttttaataatactgactcaattcatccattaatttctttcccatattaatacctgatttttccgcatcacactcattaaagcagcagcttgcaaataccatatttttttcatttgcaagcatacaagacatatgaattgtatcgttattaacgtactgagctagcgctgctaatggcgtatcacaagaaccattaattgtttttaaaaaacttctttcagccattacacaaacgtaagactgatggcaatttaaaaccttaatcttatttattatactatgatcatcaactctgcattgaatacctattgcaccttgtcctactgcacttaacattattttaggacttaatatttctttaattacatcacatctatttattctgattaatccagcttcagccaatactataccatcaaattcaccaacattagcctttaatattctagtgtctatattacctctaacaggaactacttgaagatctggacgcaaataatttaactgtacttttcttctcacagaagatgtacctatggttgcattaagaggaagtgattttatatctttatgcttagatgaaataaaaacatcatatgggctattacgttttaacacacaaggaatgatcaacccctcacaataaaatgctggtatgtcttttactgaatgcacagctaaatctactttccccattaataatgcttcctctatttcctttataaataagctttttccacctatagcactcagaggaacctgattattgatatctccagaagtcttaattttaacaatttgaacactaatttcaggaaaatatctgtttaacagatttttaatttctaatgtctgtgctatcgctaaaatacttcctctcgtcccaattcttatattcataatgaattagcaaaatactcataaaagctcaataataacaaaactatacgccacatgctacagcatttataaacaaatcaaacgaaaacccaatatcaagcttgaatattcaatcaatatagctttatatgcaatccatttatactaacttaagtataacctcctttatcaaaagccctaaaaactaggaactcataaaaatataatctacagtattgataatttagcttgatgctattaaatatatgttaattaataacccttctacttctaagatataatgcctttaatggataagaaataataactagcatacattataaactcacataaatttacaatattacactcagttcccatgctgagaatcattaataaatacatgacagaaggataccgtgttaccttaactcgactttctctataaaaacttcaagataataataaaactgcatgtatcaaattaaataactctgcagaaatatattactccatactgttttctaataaaacatctccggctaaatataatgacccacaaattaaaattgtagactttctattacaatctcctacttctaatattttagaaattgcatctgccaaagtcttagccgcaacagcttttatacctaatgacaatgcagtctgtaatagttctgctgcagtttgagctcttggttcagattttatacaaacactagacaagaattttatataaggttttaaataatttaaaaatacagcactatctttttctctagtcattccaataataatgtacaaatctcctaattcattattctgtatccaacgtgatagcatttcacctccggcaggattatgagccccatctaaaaacaaatcccaaagttgaggcaccattttagataggaaaccagtagtaattttttctaatctagctggccaataagcttcttttaaaccttgaacaatattttcataatctatattatacccaaacttaccagaaagtatactacaagcagctatggcattacctgcatttattatctgatgttctccacgtaatgagggcaatggaaaaagtaactcatcaacactactcttaaaaagcatactatcgcctttcctttcacaaaaccaatcaattccccctcggtataacggaacgtttttcttaattgcatgatattctagaacgttcattattgattcttgatcttgtggggcaataacacaagtaacattctctttcattattccagctttctcaccagctattaattcaacagtattgcctaatgcttctgtatgctctaatgatattgaagtaataatatttaatattgggtgtactacatttgttgcatcaagacgtccaccaacacctgtttctactaatacaatatctgcgtcaacttttgaaaatgctaataatattgctgcagttgtaccttcaaaaaaagtaacagggataccctcactggcttctctacaaatctctataacctcatgtaaatattgatcagatattctttttccagcaaggactactctttcattaaattctactaagtgtggcgaagtgtaaatatgagtttttagacctgcagaattcaaaatataacgtataaacgatatagttgaccccttaccattagttccagcaatatgtatcactggaggtaattttttttcaggattacctagcctatctaataattgtctcattctaccaggaatcatatcacaaaccagatcagccggtgctaaacctataggtttaggccagtggggcatacttaccataccctacctccttaggtaactcaaaaaaaatgattgcataactagatacaagatattatataccctatccaataaatatcaatacccaaacttttaaaaaattagatacccaacaacaaatcttaaattcctaatctattcacagttatttttataattgagtttaatatccatattcatgaaaagacgatataagttacaaatacctgattttcaaaataaacaatagattttcagtgaattactttcagtttatcaagtatatttttaaattaccaaaaatttaattgttttatcgtagataatatggtaatttacagccactcttatctacttactcaaacatgaaaaacattttaaaattatctattgcagaaatgcatgacaacttaaaaaaaagagaattctccgctgtagaattaactaaacttcatattgaagcagttaacaacgaaaaattaaatgcttttataaccaaaacaccagaaattgctttaagtgcagctgaaaaagcagattacatctttacacatcaaaaagaaaatttaactcctttaactggaattccagtgggtataaaagatttattctgtacaaaacacgttagaacaacagcatgttctaacatattaaaaaattttacccctcaatatgattcaactgttactaaacggctacttgacaatggagctgtcatgctaggaaagttaaacatggatgaatttgcgatgggatcatcaaattctaacagttgttttggacatgtaaaaaatccatgggtaagagcagatggtgttgaagttgtacctggaggatcatcaggtggttcaagtgctgctgtagcaggattcttatgtgctggtgctttaggtagtgatacaggtggatcagtacgtcaacctgcagcactatgcgggatagtagggctgaaaccaacatatggaagatgttcaaggtttggtatgatagcatttgctagctctcttgaccaagcaggagtactgacacgtacagtagaagatgcatccttaatgttacagtcaatttgtggatatgatattcaagattcaacttctgctaatatagctgtccctaaattttctgaaagtattacacatacaattaaaggtaaacgtattggcataccaaaggagtatgaattatcgggtaaatatcaagaatatactgaagtttcagaaatgtgggccaagggaatacaatatctcaaggatgaaggagctgaaattatagaaattagtttaccacatacaagttatgcattacctgtatattatattatatgttctgcagaagcatcttctaaccttgcaagatatgatggaataaggtatggagcacgcatatcatctgatgacattaatgagatgtacgagttaacacgtggacataattttggaacagaagtaaaacgcagaatattaattggagcatatgtattatcatcaggatattacgacgcatactataataaagcacagcgtatcagacacttagtaataaatgattttgttgagtcatttaaaaaaattgactacatactgactcctactacccctaaagaagcattcgcaataaacgaacaattagatacattaactatgtatttaaatgatgtattcaccgttccagcaagtttagcaggattacctgctatttccgttccaataggattatcaaaaagtaacttaccactttctttacaagtaataggtaactattacgatgagggaggaattttaaatgtagctagtattatagaaaaacatacaggaaaaattttaaaatagagggtaaccattatggctggtcattcacaatttgcaaatataaaacataggaaaggagctcaagatgcaaaaagagctcaaaaatttacaaaattaatccgggaaattattgtagctgcaaaacaaggattaccagatccagaatttaactctagattaaggtctgcaatcattgcagctaaaaaagaaaatcttcctaaagacagaattgatgctgcaatcaaaagtgcaactggaaatactcaaactgataattacgaagaagtagtatatgaaggttatggtccaggaaatatagcccttatgattcaaactttaactaataatcgcaatagaacagcagctgaattaagacacgctctatcaaaatataatggtaaattgggagaatctggaagtgtaagttttctttttaatcatgtaggagtcatagcatataaagcttcatctatagacagctttgactcattgtttaacaccgctatagaattacacgctttagatgttgaagaaattatacaagatgatactcaagaaaagatatactatgtcatttgtaatgttcaagattttggtaatgtaagagatcaactatttcataaattctctgatgctgagttttctagactattttggaaagcaagtgatactgtaaaaatagaagatgaagaaatacaaaagaaaatttcaaatctaatggatctattagaaaataacgatgatgtacaatatatagacagcaactttactttctattaaaactacaatggtaagattgaattagttaggtgtataagttataatatttttatattgatcttttagtatcactattcaatataatacacgtatatgaatgggtgaaaatgatgcactgtgtgaataagtgttatttttctgcagaactaccacccaacaacggttaatctttctttaacaatttatagcttgcgttcctaatataggttttgtattctataattagttattcgattatggtatttatgttaaagttgttattatgcttatttttgttgtatattttaataaatcgagtaaaatctaacagttaattttttcttatactattatgatcacgaaatcctatgctgatgaagagttagtaagtttaggtaaggctttacagttgattcggggtcatctttgacattgacaatttaacaagtttattagctgaccttagtctgcagtgttctagtacgtccctgtgggatgacaattctttagcacaacgtattctatgtgaacgtgctagaatatctaaaactctaaactcatttacagaattagaggaagagtataattattatactgaactattatccgttataaataatgatacagatgaactactaaatgagttagaagcaggtttagcaaaattaaaagaaaaggttcaaaaaaaagaagttgaatgtctattttctaatgaagcagatcataatgattgctttatagagattcaatctggagctggaggtacagaaagcaatgattggtctagtatgcttttccgaatgtacgtaaggtgggcagaaatataccataattttaaaacagaaattgtccataagctagatggagaagaagtaggagtaaaatctgctactataaaagtaataggagataatgcatacgggtgggcaaaaactgaaagtggcattcacagactagtacgtatctctcctttcaattcaaatgctaaacgtcatactactttctcaagtatattagtttccccagtaattaatgaagatactaatattgaaatcctcgacaaagatttacgaatagatacatacagagcatctggagcaggaggtcaacacgttaataaaacagaaagtgctgtacgtattacacatataccatctggaattgtagtacaatgccaaaacaatagatctcaacatcaaaatttagctgaagcacataatttactaaaaagcagactgtatcaactaaaattacaagagaaagaaaaaaaaatggcagaagaacacaacaaaagatgcaatataggatggggtaatcaaattagatcatatgttatgcatccatatcaaatggtaaaggatatacgcacagggcatgaagtaggtaatgtaaattctgtattagatgggaacttagattcatttatcatatcagcacttacaacaaaaatataattctattgataacacataatctcagcaccattacaatatctaagtactacttcattcacttgtatacaatatactcgacaataacaataaatagattaatagttacaaaatactataactgttgcctaatttttattatattaactactttaaacccaaaaaaaacagaaatcttttctataataattggaatggcatattgtatattaattgccacacctccattattcacaacaagatataaaactcctgtgttcatagcatttaagaacgatagtttctttggcttagcaacttgtgatatttcttctccaacaatattgttccaattaaaaaacagaagtacttcaatcttactaatatgattcttatcacatttatttaatattaacttttcaacagcagaccctatagtcttagggccagatctaaacaacatgttgtctacctcactctactatatggatttagattataaccactaaaacaacatttatttaatattaatttctcaacagcaaactctatagtcttaaggccagatctaaacaacatattgtctacctcattctactatatggattcatactacaaccaccaaaacaacaaacatcaatctcactagttagacttacgtcgtcactactactgtctatttctatatctcttccagtacataaacaggtatcttctataggtccaaagttaacaccatctagtaccacatccgacactactatattgctccaatatatactcataacatattttcttgcaccattaactaactcctgaagagtacaactaggtcctaatgacgcttgcagtaaattgagagcaggagagatatctaaccctattaatttataactagcaaatgtaattattgaatatggatcattacctaatagtgaatctggctcactaccgaagagttgttttacctcctcgaccatatcatgctttccttctgcatttaaaatatttttaagtaacatatttgacctagtctcaggctctatagcatcttgaaattgatgagccgcaagagcaagcatcccagctacaatatcatcttctcttactttatcactaagtagctccaaaaatgatctaccagatgttgtaaaacgattctctagattacgatatgaagatagtctgtcatgtgtctcaaaaaacttatattttattttatcacctagtacaggcaaatcgtcgtcattaggatttaaatccttttcaataatataatcccggaataagcgtactttttgaactagtgttttatctttcaacctatctgcactacttaaaattgatgcagggctaaagtgcagtaaaaaagacaaagctaacctaccgtcaccgctattaacccaagcttctgagtcttgacaatcatcagatggaaatatcaatgtcggactacttggacatgaacgcaatagacctcttaataccacctcatacaaagttatagtatcaccaccatcactagctgtatgagatttatcctcaactttcttatgtaacaggaaatccatatagtctttacttagctgtcgcctataatacgtataatacattagtaggttcccgccttccatttccacatactcaatattcattgatgcatcgtcttggtattgacttcgaaatttctcactatttttattaaatttagttatgcaatataaacctggaccttcaatctgagcagcttgttgattgttaaacaatacagcacatttacgactaccatctacaccaacattaaccgttttttgagaacataatccatattttcgagttacttttaatacaatacttttctctcgttttggtcctaaattcagtatagatgcacgatcatcacactcgattttagaaatctcattaccaaaatttaatctccttactgtgttttcagtcaaggggacaaatactattacttgcttaccttcttcaatagatggtaaagcagcctcaatctttgtataggattgagaacacatcatagctatgtgtacaatagtgacaagcatagcaatagccatcactgccataattaatatagcagccacatttaaatatggatatgacccactaatatcgtttctaaagcgatataataaagctgcagcagcaaaaatcagaaaacatgtgagtaatacactcaaagattgggttttattcattttctaagaccaactaattttaaataggatgtatattatagaattcattacttaattagtgtaacacattacataaaaattgtacagtacattaaaaaaacaatgccttaggttaacaaacttatagcagtattacttaatatgaaatcactaatttatataccagcagctctattaactataaaaataattaacagtatgtatcattatacatgatacattagtaataatattcaatactaaatttatagtaactatattcaatataccctaaagatgcaatataggatgggataatcaaattagatctatgttatgcatccatatcaaatggtaaaggatatacgcacagggcatgaagtgggtaatataaattctgtattagatgggaacttagattcatttatcatatcagcacttacaacaaaaatataattctattgataacacataatctcagcaccattacaatatctaagtactacttcattcacttgtatacaatatactcgacaataacaataaatagattaataattacatactataactgttgcctaatttttattatattaactactttaaacccaaaaaaaacagaaatcttttctataataattggaatggcatattgtatattaattgccacacctccattattcacaacaagatataaaactcctgtgttcatagcatttaagaacgatagtttctttggcttagcaacttgtgatatttcttctccaacaatattgttccaattaaaaaacagaagtacttcaatcttactaatatgattcttatcacatttatttaatattaacttttcaacagcagaccctatagtcttagggccagatctaaacaacatgttgtctatctcactctactatatggatttagattataaccactaaaacaacatttacttaatattaatttctcaacagcaaactctatagtcttaaggccagatctaaacaacatgttgtctacctcattctactatatggattcatactacaaccaccaaaacaacaaacatcaatctcactagttagacttacgtcgtcactactactgtctatttctatatctcttccagtacataaacaggtatcttctataggtccaaagttaacaccatctagtgccatatccggcactactatattgctccaatatatatccataacatattttcttgcaccattaactaactcccgaagagtacaagcaggtcctaatgacggttgcaggaacttgagagcaggagagatacctaaccccattaatttataactagcaaatgtaattattgaatatggatcattacctgatagtgaatctggcccactaccgaagagttgtcttacctcctcggtcatatcatgctttccttctacatttaaaatattcctaaggcacatatttgatctagtctcaggctccgtagcatctcgaaattgatgagccgcaagagcaagcatcccagctacaatatcatctccttgtacttgatcacgaagtagcctaaaaaatgatataccacgtgttgtaaaacgattctctagattacgatatgaagatagtttgtcatgtgtctcaaaaaacttatattttattttatcacctagtacaggcaaatcgtcgtcattaggatttaaatccttttcaataatataatcccggaagaagcgtactttttgaactagtgttttatctttcaacctatctgcactacctaaaattgatgcagggctaaagtgcagtaaaaaagacaaagctaacctaccgtcaccgctattaacccaagcttctgagtcttgacaatcatcagatggaaatatcaatgtcggactacttggacatgaacgcaatagacctcttaataccacctcatacaaagttatagtatcaccaccatcactagctgtatgagatttatcctcaacgttcttatttaacaggaaactcatagagctttcagttagctgtcgcctattatacgtataatacactagtaggtctccagcatgtgttgtttccacatactcaatactcattgatatatcgtcctgtaattcacttcgcaatttctcactatttttattaaacttagttatgcaatataaacctggaccttcaatctgagcagcttgttgattgttaaacaatacagcacatttacgactaccatctacaccaacattaaccgttttttgagaacataatccatattttcgagttacttttaatacaatacttttctctcgttttggtcctaaattcagtatagatgcacgaccatcacactcgattttagaaatctcactaccaaaatttaatctccttactgtgttttcagtcaaggggacaaatactattacttgcttaccttcttcaatagatggtaaagcagcctcaatctttgtataggattgagaacacatcatagctatgtgtacaatagtgacaagcatagcaatagccatcactgccataattaatatagcagccacatttaaatatgggtacccaccaatatcgtttctaaagcgatataataaagctgcagcagcaaaaatcagaaaacatgtgagcaatacactcaaagattgtgttttattcattttctaagaccaactaattttaaaggatgtaatagaattcattacttaattagtgtaatacattacataaaaattgtaaagtacataaaaaacaacactttaggttaataaatttataatagtattacttaatatgaaatcactaatttatataccagtagctctattaactataaaaataattaacagtatgcatcattatacatgatacattagtaataatattcaacactaaatttatataactatattcaaatatacccatgaagatgcaatataggatgggataatcaaattagatctatgttatgcatccatatcaaatggtaaaggatatacgcacagggcatgaagtaggtaatgtaaattctgtattagatgggaacttagattcatttatcatatcagcacttacaacaaaaatataattctattgataacacataatctcagcaccattacaatatctaagtactacttcattcacttgtatacaatatactcgacaataacaataaatagattaatagttacaaaatactataactgttgcctaatttttattatattaactactttaaacccaaaaaaaacagaaatcttttctataataattggaatggcatattgtatattaattgccacacctccattattcacaacaagatataaaactcctgtgttcatagcatttaagaacgatagtttctttggcttagcaacttgtgatatttcttctccaacaatattgttccaattaaaaaacagaagtacttcaatcttactaatatgattcttatcacatttatttaatattaacttttcaacagcagaccctatagtcttagggccagatctaaacaacatgttgtctatctcactctactatatggatttggatcacaaccaccaaaacaacattcatttaatattaatttctcaacagcaaactctatagtcttaaggccagatctaaacaacatgttgtctacgtcatattctactatatggatttggatcacaaccaccaaaacaacattcatttaatattaatttctcaacagcaaactctatagtcttaaggccagatctaaacaacatattgtctacctgactctactatatggatttagattataaccactaaacaacatttactgaatattaatttttcaacagcaaactctatagtcttaaggccagatctaaacaacatattgtctacgtcatattctactatatggatttggatcacaactaccaaaacaacaaacattagccccacttattatacttacgttgtcactactattttccagtgccatatcttgtccagcacataaagagacattttgtgcatttccaaactcaacacagtccaataccatattcggtactactatatttttccaatatatatccataacatagcctcttgctttatcaactaattcctgagcagtacaagtaggtcctaatacacttcccatgagcttgagagcaggagagatctgtaaccctattaatttacaactatcaaatgcaattagtgaatatggatcaccaattaatgtttgatctggattcttaccgaagagttctcgtacttccttaatcatgccatgctttccttgttcagataatataccaacaaagaacatatttgatttagtatcaggagctaaatcattctgaaattgatgagcagcaatagcaagaaccccaggtaaaataccttctttgtcctcttctattttagtacgaagtagagtaaaaaatgaactaccagatgttgtcaaacgatcctctatattattatatgaacttattttctcatgtgtttcaaaaaacttatattttattctctcacatattataggcagatgttcgtcatcaggagttaaatcacattgagaaatatacctctgcagaagttgtactttttcaagtacttctttatctttcaaattctttagagtacttaagattgatgcagggctaaagctcattaaaaaagacaaagctaatttaccatcatctctattaacccaagcttctgagttttcatcacaatcatcagatggaaatattaatgtcgaactacttgggcatgaccgcaatagacctcttaacattacctcatacaaacttatagtatcatcatcatcactagctgtatgagatttatcctcaactttcttacttaataggaaactcgcaaagttttgacctagagttcgcttacaatacctatgccatacttttactttcccgccgtgcacttccacatattcaacagtcaatgatgtatcgctctttaatctatcttgaaataccccactcttttcattaagtttagttacgcaatataaacctggacctttgacattagcagcttgttgatcgttaaataacatagcacatttacgattagtatctacctgaacatcaaccgttctttgagaacacaatccatattttcgagttaatgttaatacaatacctttcccattgccttgtcctaaattcattacagatgcacgagtattacactcgattttaaaaatatcaccaccaccaaaatttaatctacttactgtgtcttcagtcaaaggaacaaatacaagtacttccttaccttctttaatagatggtaaattagactgaatctttgtataggattgagaacacatcatagccatgtgtgcaacaatgacaagcatagcaatcgccataattgccataagtaccataagtaatatagcagccacatgtaaataaggtgtcgtagaaatatcttttctaaagtaatatactaaagctgcagcagtaaaaaacagaaaacatgttagtaataaacataaagattgggttttattcatcttctaagaccaactaatttcaaataggatgtaatagaattcattacttaattagtgtaatacattacataaaaatcgtaaaatacattaaaaaaacaatgctttagattaacaaatttatagtagtattacttaatataaaatcactaatttatataccagcagctctattaactataaaaataattaacagtatgcatcattatacattagtaataatattcaacactaaatttacagtaactatattcaaatatacctataattatcttataattacattaattaccaataacatgttaagtataaaacaaagaatttacataatattatgctaatccataccttatcataaatatcaaatttttactacctttttatactactctacctttaggactatttccatttgctaatttttcaacaaagctacgttttaatgtgtcattagcaatatcactagtaatatcatgaacactatagatacccatagaactagactttgtattagacatactatgacaaccctctttaatatcagcaggatctttcttagaatcagcactacatttatctttagaagcattatcatcactaccgttagcaattattcctgatcttaacctaggatttactttatctaattgtttagaagccaaatcaacataatactttacagtagaatcattatacacatcataatatttataagatttaaaaagactcattaactccaacacatgttcaggacagttctcaatatctttcaaaccatgaagtaatttcataaaaacagaatcctgtgtatgtataaacatagcctctttcaacattttattaaattcatccttattcttaacactaatgtgttcctcccttaccaaggatttcattttatcatgagcgttatttgcatgttgagattttttaaaattcaatttaccaagtaatgatatacatttacgtgcatcactagaatacattgcatacatactaggatgcttacaaataaatctagcagataatatagccaatatcttctcttcttctgtaaacaaagacgacattaactcttgatcaagtgtatcttcattaactacattgttagataacagcttatctaatatattattaaaatttttatcaaattcaggaaataaaacataattactactatcagatgtaaaaaaatttttaggtttctcaacattatgcacagaagcaatagcatctgtaagacttgcatctaaaactttatctgcagtgtttaaagaacgtgatactgtatcatcaaactgttttttagaatgccattctgctattttacttgtaatatgtttaacattactcaccaacagagtagatgcaataaccataaatattttgagggctatcatactaggaataacacttgcaatagatagtgctacaaccactgctagtgctgcaatcacaaaacctattgctattttaactgccattttataagaaattctcatataaattattttattaatttttattaagttttttataaataataatattacttattaataaaaatatattaaatattaaaatttaatttttgtcttttttattgaaatcttaagataatatagttatattttatcaaattagtaaatatataaatattttttaatatataaacacatcacatgttataatttataggaaataataaatctaacattgatataaaaaaagaaactattaaatatacttaacatactttaattctaccaccaataatagtaactttaatatattaggttacaaacaatactgccccatacccatacaatgtattatgatattaatatgctattatcatcatgtgtataagcacagtaatattgaatgcagatggaaagtaatgcctttaattatctgttttttatcggtcaccctatcaaaatttgacacatctttatcaaaatcaaactgcttaattattcttaaattcagattatatactgctagaatatatgattttcatttattacaactttcaaatacgtatacttttccttttactaaagatttgatttgctacaatactgctaatttatcagcactgttttctcatgtgcaatatctacttgagaaatcattttaatgaattctatatttcattagaatatacagtacgctatatagaatatttacaaacaaatccagcagctattacacaaaacaaagaactctccacccaatagacccttccgtttttatcgtaacagcagtttaatctattatctaagactttattgaatatatggctaatctcaaaaaaagttgatgttgttggtagaggtagggattattatagattgatggttactatggcattaatataaggactattatcattgtaattcatcagtaactttaacaatattatctacaacatccttaacagtacaatatcgtagtctacaacttcatccaaaattttagaaacacatgattgtcattcaatagtgattgatcaagaaatagatctacaagttctttatcttctactttttctttgaaaacaccacaatataacacagatgacaagataaccataaatattacactaagcagtacagaaattataatctatccacttttttcgtatcattgatactatacaaactatcaacagcagaaatatactagcactaaaaattactaacacttaaaaataaatcactttcacgtaaatactctatttaactagtatgcaatataaatatatcatatatagtatattttagtataataataaacattatatacttaattattaattattatcgaatatttttcttaaaataatttaataagattacactttagtgttaaacatcacatatacttgaactaacaattttattataaatcaatgaattaataacaatctaatataaaaaacctagtgctcaaaatacagaataacaactctagaaatgccattgaatgaataagatttatctttcagcaatatcaagcaatttgttaacataactctgtaaattgatcatacatactacatatgtatattatgaacaatcccatgttcataccttccactctttttaccgcagtacaattattaaatgctgtagaacattaactctatttttatataaaaacctaagacatataacaatgcactacaataacaatcaactacaactaaaaaactcatagaaatcactgactttcctacttgatccatcaattcaaaaatattttttactactttgacagaataacttcatcaaaatttacagtcagtacacacacatttcccttgaatatttcaattgattaatcaaaaaattgataaaataaaaaaaaatgcttgatgttaacgtaaattatattaaaaaccttaatttggattttattatgtatccaactatcagtaccagtagtcaatgtaaacaaggaacagaggggttaatttatgaaatgtattacaaaataataataataaagaagatgttgcatcaaacattgagaaatttggtgaaaatgctgagaagttatattataaactattgaataacatatgtttttcatatatgattactcattaataataatttacaagtacctaaacagcaatatggatagatatactgcatcctaataacctgttaatcagcatttttataagttatttatataaaaaccctcatttataattttctcacaacaaaatctatttaacttataagcaaataacatttgtaactaacattcctagattagtaaaactctttgaacctaccgaacacaaagtttattataaacaaaattacccttttttacattatcaaaacaaacaccttttataaaaaaacactacaacttcaattgaaatatttcaataaaaccagacctaataatatcataattatatatttttattaaaaattaagaataatttatataaattaatggcttccacgagtcattgcactatttcctaaaacaggcaaaatcgtatgttgataccatttctcaccaatagactcatcattagattcttgggacatatcaatactattagatagatccatctcacacaatggccaatatatactattatgtctacagttaactgtttcagcaattattgtcattaaagatcgataatttctctccaggtaacaaaaattgaaacttttcattctattacatgcagcatctataacatgttgttctactaaggacgaattataaagagaagtatacattaaactcaccaacacaatatcaaaagaactcccaaaagtaactctagaattgtccaatcccgtatctaaatctttgtagtattcattataagaaattaaaaatgaattaatcatttgttggaactcatcctgatccttaaaaacacatatatcatatgaatcataagatattatcatattagcagtacaatatatatctatatctaaacgagccaacattctaatataatcaacaatattttcaggataggaatgcaacaaataaggcaaacaacacacaactctagcgcaacatactatatttctaagtacatccttaagtatatgtttatctaaaccaaattgagatgcatcatcattataccatacctttaatatctgatcctgagtcatgggtaaatcaggacgagtatgtaaaataaacaatcctacatccaatttagcttttaaccttgtatataaaatataatattccgcatctttaaatctattagctgcttctgcttcacactcttcaaaatcagcaagactccaagtaaccttatctactatcctagcataatcataaaaacttgaaaaaacactaaaaagacattcttcctgattcataatcatactcaattctttagaaataaacatcctattataaggaggaccactatatgccatattaatcatcaatctataataatccctaccgctactaacaacatcaactgcatcataatgggttacttctttaaccttttctataacatcctctatagtacctaataatctggtcactttatctgtttcaaaggaagaaactcgtctattattttcaatgacagtctgttcaaaaatttgagagattatctcctgaacattcagcacactacaacaattgtctatcaactcaacctcaaaaccagattttctcatgttacagatacgttcaataataggttcatcatccacagccttaggctcatcatattgtccaattatattagaagctaaatctatttcctgcgtaactacagcatgtgatctatgtccatatatacaataatacttaaaataactcatacagaatatctcttgtaataatttaaacttttgatcattattaaccatcctgtaaaaatcattttcattaccaatttcggatacacagtcatgcatgtattcacgaaatacatttgataaaaatttacatagttcatcctgactagaaaaactatatactttatttcctagtaatcttattattttattagccgaatttagtctttcctgatatggtacttcctctatagataaattatataacatggcaattttatcatatgcactttcagaataagttgcatacaaagcttcatttctaataattaattgtgctgctaatataacaaatgtaaaattctcttctcctaataaatctttcacctttctaatatcaacaggattatgttcaacaaacatgccagcacatattaacttatctaaaatataatcaaaataccctctaaactttggaaaaagaagaacatcacgactaccatgtacaacattgagataatggtttctacaaggataagattccatctcagaaataccatatggctgagatataagcaatttaaggttttgggatatagaacataaattacgatggatagaataatttgcagcataatgctctggtaaaatagttgtactatactcaggaacgtacctatttagtataataggctctggttctacaggtaaaggtgtattctcatctttacgagtcaataatctcttatatacagatttaagtaaaaatatagaacatattaaacaacatgataaaagcgctataaactgattgatagatactttacgcgtaatgtacatatacaataatacaacagaagcacagtatataaacattaagccaataatattaagagccgtaaaagccttacttcgctggaaattcatcataagaatatcttgatatattaataaaatatattaatataataaaacttttatactaaaagtaaataaaaataattactatacattaattatcttttaactatatattaattgtttctaataaatgtatgattttttaccttttatggatattgtaatataataattattataaatagaaatggatgttttaacttacgtaattccaaaaatacacaacatcagtaatcaattaagtaaatcactaattaataaatatatatttttaactaataatatcatttattacatataaacttataacaatcacttactcagattaagtactaagttacaaatctaagattttattaacagaaaatccaatgtgtaaaactcagaattataaaataatataaatggatatttcaaaaaaaaaaaaaaaaaatatatatatatatataataataaataaactttttgttatctcttaaataataaaatacagaatgtccacatacattaaaaacaccatctatttttataatccaatactagcaatttgacttttagtagtataaaaagccagtttattataaactggtttattatgatgattacatctaagatcttacaaaactgtaaacttatgaataacactattaatcattagaaaaactattttttattattaagaatgcttttcaatgaatctctctgccattcccatattcacatcagcagaatctaagtacatactaacaccacgattaaaagaagccataggaaactcaacatcatcactatcaccttgacataaaacttcttgaatagattgaacatcctcaccatcacttaggtcctgatcttgtatatcagaactatcactttctgattgaccgatggcatatgaaaagctatatgcttgcctatgtctcgtttgaaaaaaagtttctttcaaatttgacaacacactacttctttcttccttattatgttggtcagtacaatcagcaatagtgttattatataagatattaacagttctatcaaattttacacccagataattagcacaaagtaatactaagccatacaataaaaagaatacaaacatacaagccataacgcaactcaaatcttgatgttgcatattcacacaacttaatgctaatcctacaactgaagcagttattaccgctatattgcatataagaactactatcctactaacttccatgcaaaaacacctttacaaacacgtatgaatatctcttaatatataattaacttattaataaaaacacgctctaataattttcttaccctaccataaatccctataaagaaaaaaatcattataaagtatacaaaacaacttaaatcactatatcaacacatacaatacaactaataaattatacaacaggttaaattttatatcattaaataccactaatttctaactttgctttgttctttctctaacgttgtcacttcctcaacatcactatcagtaactatttgccctacactttcctctgctatgccttgagcaatattagttttgcctacttcatcgttaataccagaaaaagtcttcattccaacactattacctacagcgtcatcataataagttgtcataccacatactctatgaaattgaggttcttcataataaaaatacacttgttcatccctaggcatttcaacaggtcttacacttgaatcaaaataataatctgtagatagaccagtatctggattataataattaggagaagaattaggttctgatgaaaactttgtcaaataattatttaactgagtatacttttcacttatactttttttataatttgcacataataatgcaagtgtagctataagtataagtacaaacacaccaacataagcctgaccatgacgtaccttacttgtacaacacaatgtcagtcctactattgcaccaacaatagctattaaactactacaatttattattgtatcatgatattttgccataagtattaacctaaaataaataaaaaattaatatacgatttattattttaacctttatattatgctttaagattttcaattatttattaactattataaagattaaccttaatattaactaaaatatataaaaaaataaatattaatttttataaataattttaatataataactaatatattaaattttaactataattcaaacatactattttttatcaagtaatttattttattacttagatatacttatattatttgataattgagctataatctgactatcatccatatacgctccagcattaacagttttttttttgtttagcctcatatctacgacgtaaaacttttctttttctaatcttcacaacacttagataaattattattcaactgcctaacatctttacttttaccactttgatactatcatagtatatgaagccttttcttgtttagttttagcaatctctataacaacatgttacttaacaagattctatcaacaatattttacttaattagtagaagtagtattctctatgcttttaccataatataaacaataaatcctaagttacagaaactcttaaataaactacataatctttatttggttaaaaaattatattaagtattaatatttaataacaacttaattaataaatattaaaaactgattgttcgcatacaaaagatacattatagatcaaaaataaaaaacttaataaatatcaatatttaattataatacctatactactaattaattaaaattaaaaaattaataattgtatttagcaaaaatattacatttttataacaacataaaaaagctaatctattatttttaacgcttgaataaacgcattatgcggaacattaacattccctatagatcgcaatcttttctttcctttcttctgtttttctaataatttcatccttctggtaacatctccaccatataattttgctgtaacatctttacgatacggagaaatagtttcacgagcaacaattcttcctcccactgctgcttgtattgcaattttatattgttgtcttgggattaaatctttcaacctaagacatatttcacgtcctctctgttccactttacttttatgaataatacatgcaagagcatctactggttcagaatttattagaatacttaatttagcaatttcactatccaaatattcatccatttcccaatctaaactagcataacccttagacatagactttattctatcataaaaatcaaacacaacttcagataatggtaatctatattttaacaatgctgtattacctgaatatgacaaatctagtttttcacctcttttattattacataatgacataataacacctaaatattgatcaggtaccataatagtagcacagatccatggctccttaatattagcaatatcttgcgattcaccaaaatcatgaggattatgaactttacgaacatcaccacttctagtagtaacttgatagattacccctggagctgtagcagtcaaatctaaattaaattccctttctaacctttcttgaattacttctaaatgtaacattcctaaaaacccacaacggaatccatatccaagcgcattagaaacctcaatttcaaaagtaaaacttgcatcattgagttgtaactttttcaaagcttcacgtaatctttcaaattctccagcttcatttggaaaaatactacaaaacactacaggatgaatcgtcctaaatccaggaagtggttcactacatcttctctgctcttcagtaattgtatctcccactttacaatcagataattctttaatagatgcagtaataaatccaatttcacctactgaaagttgatccacaactttcttatgcggggtaaaaatacctacattatcaacttgatacacagcattatttgacatcatgacaattttcatgccctttcttataacaccatctttaatacgcaacaaaattactataccaagatatgtatcataccaagtatcaactagtatagcttttaacggattctctgatttcccagatggagctggtaatctagaaacaatagcttctaatacatcttgtataccaatacctgactttgctgacacaagtagtgactcacttgcgtcaataccaatcatatcttctatttgcaactttactttgtctggatctgaagatgctaaatctatcttatttagcactgggataatctcatgattactatctatagccttatatacatttgctaaagtttgtgcttcaactccctgactactatctacaataagtaatgatccctcacaagcagccaaacttctacttacctcatatgaaaaatccacatgtcctggtgtatccattaaatttaagtaataagtttgtccatctttagctttatatgctaatctaacagtttgtgctttaattgtaataccacgttctctttcaatatccatggaatcaagtacttgatccttcatctcccgttcatccaaaccattacattcttctattaaccgatcagctaacgtagacttaccatgatcaatatgagctattatagcaaaatttcttatatgactttcatccatttcaatttatcctcacacctttataacctttacactttacttcccttcaaagtaataatctcaaaagtagcaggaatactaattttatctactgaaaaatattgtttataattctcaaaaatctttgtaataacagttctagttaaaggatatttatttctaacacgtaacacatttccttcacccatattttttaaatccctaaacaaagtatatatatcactatactttaccacaatagtattaacatctactacaatatcagaatatctaattttctgtaataaagaaataatatcttgaacattaatgaacggcaaaactctaggtgcaataccaaaatccatctcagccctgataatcgaatgtttcaattcataaagagttttactaccaaataatgcagcaagaaaaactcccttgctttttatgatattatatatatttaatagtacactaaataaattattaacattatgcaatgatacattgctaataacaagatcaaaaacattattacggaatggtaatgcctcttcatcggctactatcttatacccgccattcacattatataacacacaatatgataaatcacattgaactacttgttccttagaagatattagctttttatgtaataaattttcaacaaaagagttagtcctaacaccaagatttaaagccaatcctgtagcaaccgaaaacaaagcaatcttatctaataaaatatcactaattgcagaaaatataaagtcattatccttattacaagatagcctatccctataaaaccttacaagggcacgatcaaaaataagcatagagatcttctacgtagcaatctaaattaaaaaaacctaggcttcctaggaacatcatgaccatttctactattactgaatgagcgattattattcccaaatccgtttgacgatggtaaatcttctctataatagttaggtccattactgttacgacgtgatgatctactactaccaccactacgttttttttcatgactaccatgtctactatttgggttatagctctccttaaaactactaccaccagtactaccacatgaatcatcagaaaaactatttttccttatattataaagctcaccatctataggttctccactttcctgatctactctgcgcatagataattggatatgttcacgatctataccaattactaacacttttactttatcattcaaagaaataacactacctactgaactaatatgttcattccttatttcactaatatgtactaatcctttcttaccacccaagaagctgacaaaagctccaaacttcataatttcaacaacagtaccttcaaaaaccttacctatctctggttcagttacaatatccattatcatgcttttagcatattctactgcctcattgttaacagcatatatcataacagtgccatcttggattatttcaattttcgcacctgttttttcacatatatcacgtatattttttcctccacttcctattacattacgaatcttatccttatttataaaaatagattctatcctaggagcatgattttttatacgattgcgagattcttgtatcactgcattcattttacttaaaatatgcattctaccatctttagcttgaagtaatgctttttcaattatatcaatgtcaatacccgatattttcatatccatttgtaaagcagtaacaccttcagcagtaccagctactttaaaatccatatcaccaagatgatcttcatcacccaatatatctgaaagtattataaacctatcatcttctttaatgagccccattgcaattccagcaacaggagatttaattggcacacctgtatccattaaagccaaagacgcaccacaaactgtagccattgaagaagaaccatctgactctgtaatttcagaaactactctaatagtatatggaaaatctgacttttcaggtaatacataacgaattgccctccacgcaagcttaccatgacctatttctcttctaccaggagcacgtaaagctgcagactcaccaactgcatacggaggaaaattataatgtaacaaaaaattttctcttctatcaccatctaaatcatcaactatctgctcatcttgaggtgtacctaatgcagtaacaaccaatgcttgcgtgttccctcgagtaaataaagcagaaccatgcgctttaggcaatacatccacttcaatttctatatcacgtatctcatcaaatgcacggccatctattctagaagaggtatcaataattttggatctcactaacgatctttcaaaggtttttaatgcagtaactatatcttgatcactacactccacatcaccagcactatatttatctgccacttcagacaatactttacccctcaattcctccaattttaataccctttctttctttatagtgttagagtatgctaaactaaaatcctctttataagaggactctatatcactcacaagtgaactaatatcatggggtatgaagtcaataggtgtttgaccactttcatgactaaattctttaattaaattaataacctcttgacaatgttgatgcccaaaagttattgcacctaacatctgagattcagataactcagatgcctcggattcaaccatcaaaacagaatcttcattacctgataaaaataaatctaaagaactacagagcatctcatcagcagatgcatttaataaatacttaccttcagatggtaaatagccaacccttgcaccaacaaccaaaccattaaaaggaacaccagatatagataaagctgcagttgctccaactaatgctgtaacctctggaggtgttacagtatcatatgaaagcaaattacacactatactaatctcatcataaaatccagcaggaaataaaggtcttatactcctatcaattaaacgagaaatcaacgtctccctatcagatggtttaccttctctcttcaaaaaaccaccaggaatcttaccaacagcataactcttcgcaacaaactgtacagttaatggtagaaaatctaccggttccttagttttacctgttactactgttgccaaaactgtagtaccggcataactaaccataacggcaccactagcttgtcttgctatctttccactctctaaaactaaggttttccctccccattctgcagatcttcttatcaaattaaacatacattatttcctacttttctataaattaaatcagtgaaaaatatccctgatacctaatcgttttatcaatgctaaatattcactatccccatatttcttcctaacatactgcaatacattacgtcttctacaaaccaataccattaaaccacgtctacaatggaaatcttttttatgaacttttaaatgctcagtcaaattacgtattctctctgataagattgcacattgtacaaaagaagaaccagtatcatcttttttaaggcaatattcacttattaattcagactttctttcacgtgtaattgacataactaaaataccaaatctttaaacattaaaaatacgtactggccttacaacactattaactatactacagattgccactggcacattacccgtactaacataacagataccacaattccttactacatacaagttatttaactcaatattttgaccatttttaatcttttttatctgaatatcagaaaacacatcattaagatgtttcatatcctgcaaaacataccataaaggtaacaaataactacattttctactattattatataacatctttaacatttccaaagtaatggcatttttcttcctaaaacaacctaccctaactctctgtaattttctaacataccccaaacatcctaactctattcctaaatcccttgctatagaacgaacatatacgcctttcttacataataaataaaaatctgctttgttattctcttgatcagcagacaataatttcaattttaacacgttaacatctctagaagttaaacttacatcttgaccatttctcgccaatttaaaagctcttactccattcacatgtactgctgaaaaattaggaggtacttgtcttaacaatccaataaaatttggaatagcttttttaatatcttctgaactaggtactatatcactttttgctactatctttccttctatatcatcagttgttctttgctcaccccattgcactgtaaacaaataagatttcacaacatcaacagcataaggcataacttttgtagcttcaccaatagcaatgggcaacacaccagaagctaaaggatctaatgtacctgcatgaccaacttttttgacatttaaaatttttttaactagattaactgcagaagcagaacttataccacatggcttatctaggtttatccaaccatacatacaattaaaaattcaaatcaacttaataacctacggaaacattatataggcattaaaattacatagttaccattaaataataaaaaccaaaacatctaaatgttataaataatattatagaaaatcaagttattgagtttcttttttcattttaaacattactacacttaattgataatacatacgcatatcacaagtgtaataatcatattatattaatacagcttaagtttgcataaattaatttagaataataagcaattacagtcaattaaaagaaatcattacagtgttatcatatatcaaaatataactcttacaaagattacttaatatttgtaaaatttcatattaacaatatgccaacggtaacttcattatattcaaataacccagttatacataaacattcctttatataattaataaggaaatatcagtaggttatctaaggatattaatttttatattgattatataaaataatatcaaccataaatataaatcatttatacagcaataaatttcacttattaatgaattataattatatctactatcaaaaatttatttacagatcttgaattaaattatatagctataccaatagcacccttagctcagctggatagagtttttgactacggatcaaaaggtcgggcgttcgaatcgctcagggtgcaccagttttttacatcttttgcaattataataatgtgtgagagattacacttatcattttaccacaaatcacctaagagcaactctattaaaccctatagttaagacatttattggtacatccttttatcacatcttcattgttataatttttttatcaattaataactcacttataaaatttctaaactcacactatttttcatttctacgatatgctatgattaaccaattcacaaaataaaaaaactatggctatcatgacaattaatacatcaggtcctatatgttctgttgctataattagtgaaaatcaaactatgtactatgaagaaagtacatctgacaaccaacactcagaatctctatttcaattgattcatacactatttgataaatctaacaattcatataacactataacaaaccttggagtagtagtaggcccaggaagttttactggcattagagttggaatagctgcagctcaaggaatacaccttgcatcaaaaatcactctacatggtatcagcactctagaaatgcaagcatacctgatatacaattcaacaaaaattaatgacggagaaatactatccataattgaaatgtctaacaataaattctattctcaaacttttaataatcaacttattgcaacaaataaaataaaactactagacaaaaactttaactatcatgattttacacaccacatccaatccataacgtcaaaaaattttaacgcaagagttgctgctttgatattggcttataaattacaaaataacttacctacactaaattccacgcctatatactttaatacaataaactaatgttacctagactacatgctaattaaataatgaagcctttatataattatatcaatataactactacaactaccatttactattaaataaaaatctaaaaattactgatatctgtaaatttttttataaaaagtgcctttatgatttccaatgaaaatatttgcatgagattttttgtctgatatattaaacacgtttaatacttatatgcgtatacacatgaaatctaaagcttttttcgtaaaaccgctgcttataattttagtatgttctttagtctttatagcatttggagcatcttttttccctggtagctttaacaacgaaaaatatattgcaaaaatcggacacgaaaaattatcattacaagattatacaagtgcatatcatgatgaattaaggtatatacaacatgtgctcaatcgtccattaacagaggagcaaattgcgcaatttaatattaaactttctacattaaacaagctgattgaaaacaaagtcttaacaaaatttgctgattcactaaatctcaaagtaggagaaaacagcatattaaatcacataaaaagcataaagttctttcaagacgaaaatggaaactttgataaaacaaaatttaacattggattgtcaaatgcagggcttacagaaaggttatacataaacaaattagaaaaagcatttcctataaccatgctcatgagttgtttattcagcggaacacaaaacacttacactcaatatcatccagagttaataaagcaaattttacaaaatctgcatcaagcacgtactatagatgttatagaaatatcccctacaaccaatgacatttctgtcccaaatattgatgagctaaaaaaattgtatgaagaaaaacgcaaaagtggaaatctaacatttccagaaagtagagttatagaatatgtaacaattgaccatgaaaactttattaaccaaacaaatgtaacacaagaagaaatagataataaaataaaagctgacgaattagatgaacaaagagatatatttaatttagtatttagtactaaaaatgaagctgaaactgctttaaaagcattaaatgaaggtacagactttgacagtatagttacaaatattgctcacaccactctagataatataacattgttcaacattgtaaagaatacacttcctaatgatataagaaatcaagtattttccctaaaagaaggagaaataagtcctatattacacagcatgtttggatggcatataataaaaataaaaaatattcacaaaatctccactaaagatctagcagaattaagtgaaaaaattgcccaaaatattaaaaagaaaaaagctactgaccttttatacacagaaatccaggctataaatgataagattaataacggtacatctattcaagaaatagcagaatcatataacttatctataaaaacagcaaatgttgatatctcaggcaaagatccatctgataacaaaattaaaatgttagaaacaaattatgatgcaatcgttttagctgcattttcagctcaattaaacaaaccttccaacttcacagacaatgacggttatttttttagtgtcaatgttactaagatagaaccatcaagagaaaaaacttttgatgaaagtaaggaacaattagtatacgaatggcagcatgatttaaaagctcaaaaattatctaagctaacacaagaggttgtcataaaacttaaatcaggtatagacataaataatattgatggtgtattactaaagccgaaccaagtagtttataggaacagcgttgctgcagtagataatcctggccaaaattatcctagtgatcttataaatgaaatttttcatcttaaaaaaggagaaatcagtaaaaattatcaacatgatatcagttcttcagaacaaaaaatgctaatagcaatattgaaagatataaaaaatgctgatcaagtaagcaacgtagatttcaaaaacattcaggaaaaaattgcaaatgataacttagaatcgctaaaaaatcaactaatagcacatctaataaaaaaatattccgttaaaattaaccaaaatttaattgataatgtgcggtagtctgatctctcacaataaaatgcagcttaagtttgcataaattaatttagaataataagcaattacagtcaattaaaaggaaccattacctatacatatatcaaaatataactcttacgttgagttgtacatacaacgtattatcaatttcattagattataaaaaataacataaactatataacgttgatcgcagagtatttgtaaaaacataaataatgtttcatttttactaatttaataaatgcatcccttacaaaagctatcatataaaacaaactcttaaataagattattaataaactatagacaaaacatttataaaaaataaccctgaacattaaataccatacctgcgtaatgttaaacttactaatactaataacaattactttagcttagttgtaatttaccaagaatcacatgactattcatggtaatatttttatttacaaccttgtttcgcgtaaaacacatgcttacgtatctaacataatttaaaaatgtaatactattgtttagcactctatgataatttaccacacgcatctaaaatacgatcacaagctttagataaatgttcagtagaagtagcataagatattctaaaaaatccttgtgctccaaacgcttcacctggcactacagcaacattgtaatcttctaataagtacttagtaaaatccatagcactatttataaccaaaccattccttgtacttttacctatcaactttttacaagaaataaatacataaaacgcaccttgaggctttttaacagataacaatgaggtattatttaccatatctaccatcatatcacgacgtgccgcaaatattttatttcgttcttttaaaaattcttgatcaccagctaaagcctgtattgatgcaaactgtgcaatactattaggatttgttgtactttgcgattgtataacagaaatcgcactaataactctcgaatcaccagctatataccctattctccatccagtcatggcatacgcttttgagacaccattaattgtaaagactctatcatataagcgtggctcaacttgggcaatagtgaaaaattcaagatcatcatatattatctttgaatatatatcatcagtcattacataaatatttgggtatttcaataaaacttcagcaatactttttaattcttcatatgtatatactaaccctgtaggattattcggagaattcataattaaccacttagttttctcagtaattacagattctaatatatcaggagttaatttaaatgtttcaccacaatcaacaataacaggatttcctccagatatttttaccacatctggataagacacccaatatggggatggtattattacctcatcaccactatttatagtagccataaataaattataaatacattgttttgcaccatttccaacagaaatctgattgacattataaattaaatcatgatcctgtttgaaacgatcaataatcacttttttcaattcaataataccattaactgctgtatatttagttttaccagaattaattgcatcaatagctgcttgcttaatatgctgtggtgtatcaaaatcaggttcaccagcactcaaagaaattacatctactcctgacatttttaatttttgagcttgatttgcaatttcaagtgtaggtgaaggtttgatacaccccattctttcagctataagtgacataattaccctaacatttttatataaacaaatgtattctagtacacttcaactaatattcaatattattgttatccacatcataattatataatgtattaataatatcgaatagcagatattacttcagtattctcaatatgaaataaacttaaaaaataacctaacaacccagtatacaaaacttttgcatcacacatcccttataaataaagatcacgtgataaaacaacacaagagtcctataatttagattgtaaataaaaaattaaatataaatttcatattatatgacaatttatatcataaattataattacaaaactattaaattgtagtattaagtactataacgattgttgctatataattaactaggtaattttatgaatctcataacaaaacaagctattgactttacagcaaaagccgttatgccagatgacaaaatatgtgaatttaatttgaaagaatatgtcagtggcaaatatgctattttgatcttctaccctagagattttacgttcgtatgccctacagaaattatatctctacacaatagaatacctcaatttatagaaaaaaacactgaaattattggtattagtacagactcagagttttgtcatagccattggcgtaacattagcataaacaaaggtggaattgataaaattagtttcccactaatcgcagatgactcacattttatctctaatagctatggggtattgcataacaatagtattgcattaagggcaacctttgtcatcgatgataatttcatagtacgccatcaatcgataaatgaccttcctataggtagaaacgtagatgagcttttaagaataatagatgcaataaaacatcatcaggttcatggagaagtatgcccagctggatggatgaaaggagatccagcaatggaagcatcacaacatggtattgaagattacttaaaatcacacatagatcaccttgaaaaaagtattatggatgaataaatgacacaaacatataatacaaaagttttaattataggatctggagcagcaggttgtactgctgctatatatgctgctcgtgcaaacttaaaacctatattaataactggaatgtgccccgggggacagcttacaattactacagatgttgaaaattttccaggatttgcacatgcagtacaaggtccagatttaatggaacaaatgaaacaacaagctcataactccggagctcagattatatctgacgaaataaaagaaatacattcagatgtatacccttttaaatgtataggaatatttggtgatcagtacattgcagatagtattataattgcaacaggagctcaagcaaaatggctcaacataaaaagcgaagaaacctttaaaggtagaggtgtatctgcatgtgctacatgtgatggaacgtttttcgctggtagtgatattgccgtaataggaggaggtaatacagctgtagaagaagcattatatctaacaagatatgcaacaaaagtatttttaattcatagaagagatactctacgtgctgaacctataatgcaagaacgattattcagtaatgataaaatacaagttatatggaacagcgttgtagaagaaatactaggaaataaggaaagtgggaatgtagaagctatagcattaaagtctgtaaaaactggagacatcactactatttccgtaaaaggagtatttattgctataggacatactccaaacacacaaatactaacaaccaaagataatgggaatatagtagatttagataacgaaggatatatcattactaaacctggtagtacagtaactagtcaccctggaatctttgctgcaggtgatgtacaagataaaatatatagacaagctgttgttgcagcaggatctgggtgtatggctgcattggaagctgccaaatttttatcagagcaataaacccataatctaccgatacaatattaagaattaattacttagtttagcctcttctaaagattcattttttatttcttgaaatccactagcattgtaatcaagtaatacgatttctgctcctaatttttttaacacttcagcaatgttgtttgaaaatgcccattgtaatatacaagaaatagaaatttgttgctactctttcatagaaaaggataattaaatgtttcactttctaacataatacagtagctaaaaagtaaaaatcatgttaaaaattattaaccattaacattagacttttgatagaaatttttcaaacattcttgtacattcacaggcacaaaaacacttacatctccatttaatcgtgctatttctttgacaaaacttgaagaaataaattgagtatcttctgaagctggtaaaaagatagtttcaatctgagaagtaagtttataatttacccaactcatttgaaattcataatcaaaatcagatacagctcttaatcccctaattataacagatgcattattttctttagcaaaatataccaataatccatcaaaaattacagtatttactgccatacctagcaattttatctcatgctgtataagttccgcacgaacttcagcagaaaaaatagttttttttgtacaacttctagcaacacctattactaacttatcaaccaaattataagctcgctttataatatcaatatggccaaaagtaataggatcaaaagtaccaggatatatgcctattttcacagaaaattatcaatgaataaaaatttattatatcacaacatcttaattattttaagcttatatttttacttgaacagataatatttacaatatataatttctgaacttaattaatttacaggcttgtattagcattataaaaattatagttttggcttgatagctcagttggtagagcaaaggactgaaaatccttgtgtcgttggttcaattccaactcaagccactttcggcatattccttatgttcagagtttagtaaagcctttgtggcatgtttgttcatatagcctacaagtcaatagttttacggagactaaatgcgttatttcatactaatattattttttttattttctacatcaacaattgcaatagaaacagcaccaaataaaatggttgtgggatttgtacgtactgcagaagaaacttaccctgaagaatggacattttcaaacaacattgctgaaatgttagaaaaattaggagcagaagtcgtattacttgattacaatgtaatagtagatttcaaaaaaataaaaaatgaatctttagaagaggctaaagatgatatttcattattagagaaaatagaagctgacaaaattcagcatgctgttcataattttatcaaggaacacaaaattaacagaatatttattcctggaaattattacaacgtagacactgaaccttatacaccaactccaaacaggcaacttgttaccaatgcaatagtaaaaatcatagaagacaatccaaaaattcacttaataggcgtgtgtggtggactacaaggtataatgcatgcagttggaatagaagtcattagagtaaaaaagataattgcatctcaagaagctgtagcagcacattctatttcaatgccagacccacatagaaaagatgtaggacttcatagactccgagttgtacctggaagcagattatcaagcattatttctaaatatactaaaccagatgacaacggatggattgcaatatatttcccagacgcacatggaggagtagtaaataacagtcaagaaaatataaaaaaaatagaatcccttggatatagaatagtaggattttctgacgatggtattatcgaagcaattgaagataaaaatggcaacatcttatttcaagatcatccagaagctttagcaattaacgcaataaagggatctgatcaagatgataatgataatgacaatgatataagaagacgtcaagcaactttgtcagcaattgctattatcaatgattttctttataggaattaaattagattattaaattttgcttatacaggtttaaacattttgtcaggttatataaaacatagattccaaatgttatctcctgtacaataagtatttccttcagcaaaatcataggtcttcttacagtaaactcatactaaaatcaagacacatggcctccacaatatttaataaatttcatattacattatggttttgctattattcgctcaccatacacacccatgatatgttaataaacaagtatttttctaggcacagaattctcgaacaatacttatatgataatcacttctaggaatcatttataaataacttagtcaaaccctataacattattttcttaacatatagatttgattattattcaactacgcctaacagtacattaaacaagtatccctcctaccaccaggatataactacattgcactaaccaatgctaacgaaaacatctcttttcttatactaatttctagtttgcactatccatatagtaagttactaccttacaaaacaatattatttacgtaataatcgtttatcacaattgactattgaatatatatatgatatctgtgctgcaacttgtattaattaatatttttaatgcgtttatcagattactatgtacctacattaaaagaaacatctgctgatatatcagtaatatcacataaatattctatacgtgctggtcttatcaagcaaattgcctccggcatatacacttggcttcccttagggttaaaggtactaaaaaatattgaaaacatagtcagagaagaaatgaataaatcagggtctttagaaatattgatgccactgatacaaccagcaagcttatggaaagaatcaggaagatacgatgactatggatctgaaatgttacgcattacagatagaaatcaacgagaaatgctttttggtccaacccatgaagaagtaatcactgatattctaaggacaacaccagtaagtcataaagatctaccactaattctataccaaatacaatggaaatttcgcgatgaattacggccaagatatggtataatgagatgtagagaattcttaatgaaagatgcatatagttttgataaagatttcagtggtgctatttcatcttataacttaatgttcaaaacttacatcaaaatttttcaaaagttaggcttaactccaatagcagttaaagcagattcaggacccataggaggaaatttaagtcatgaatttcatgtattagcaaattctggagaaagcaccttatactatgaccaagacattattgaattaatgaatagtgagagtattgatgttgaaaaaataaaaaatacttacactgcagcagatgacatgcatgatcctcaggcttgccctatttcatcagataaagtaaaaataagtaaaggaatagagataggtcatatctttcatctaggagataaatattcaaaacctatgaatgctaatttttgcgatagcaataataataagctcctacaaatgggatgttatggcataggagtatcaaggctagtagcagcaataattgaagtatttcatgataataaaggcattatttggccagaaacagtagccccatttaaattttccttagtaaacttatatacatcaaatgataaatgtaagaaagttgcagaaaatctacacatgcagttatatgatgacgttctatatgatgacacagatgatagtcctggtattaagttagcaagaacagatctgctaggtatgccatggcaagttataattggtaaatcaacagtagaacaagaccttattgaagtaaggaatagattaacaaaagataaagttttaatttccacagaacaattcttaaataaattaaaaaaatgatactagggattggtacagacattgtttatgttcctcgtatatcaaatttatggaaaaaatttggtactaaatttcttaaacgggtatttagtgaaaaagaaatagaagatagtaagaaatatacaaattttgatgcacaagtaagacactttgcaaaacgtttcgcagcaaaggaagcttatgtgaaagctgtaggaacaggttttggaaaatccataaaaatgccagatattatagtatctaacaacctacacggcaaaccacaaattaccataaataatagtaatataaaatataaaattgaattatcaatcagtgatgaaaaagactacgctattgcttttgtggttctatatacagagttataacacttgatatagaacataatacaacacaaataacatatggaaaaattataaacaatcagcagatacaagacaaatcaacatgataagtacgctattgttttatagcgatattaaagagtcaagtactgtaaagcataaggtaatttaaacataacaaaaaactaaagtgtacataaactttgaaaatatcatattatttacattcaaatctatatttattaatagtatataatatgaaaagtcgataaacaaaaatttttacaatttaatcagaatgatctattatttcatggcataatatatatccaaaacttattatttagtataattccatttttcaaattacaattattattaaatttttgttgcacgtaaggaatacaatatgtatattgtatatgtcttttcctcggtagctcagtggtagagcacttggctgttaaccaattggtcgctggttcgaatccggcccggggagcgctttaattcaaagttctttgtaaacctttctagaattcttaacgcatttcagtgcttattatgtctatactttaaaaaggcacttattcacgtataaatatattgacttatataaaatatagtattataataacagttgtgcttttagcactatggcaataaaggcatcttaaaatagatgtattggacccgagggcagtgctcggcatctccacttcaggtcatggggatgaaacaggatcgacatgcatagtaaaggggatagtttttgctcggtgagaaaacagccgtttaaatgctcaaaatttataagtgcaaacgataatttcgtttttgctaatgataataatagcagtgctaacttagtagctgcttagttttattattagcgcggtttttttaagggttttccgggcaacagaaaaacccttttttatatgatcagaaacttgtttatgagtaacgtaatagattatcaaaagcttatgcatgctgctatgtgtagtgtagtcaaaaacgctttaactgttgtggcacaatcagaacatttttacaatgtacatattgctatatcctttttaacacattataaaggagtaacactacctgagcatgtaaaaaacaactatccacaagaaattactgtaatattacaacatcaatttagaagcttacaagtatttgataacagtgctagtgtagtattaagttttagaggaaaagaagaaacagttgttattccataccagtctattatcaaatatatagatgtttatcaaggcttcgtactagattttgagcaatatacaaacagtgatatagaagaatttgacgattgcgaccatgatattgatgatagtaatgaagataaaagtcagaaaggtaaccaagataatatcatatttattgatacattcctgaaaaaataaaatttttacgctttattacaacaaattcattaatgtaattcttggtatagtataaatcttcacctagtgtttattcattatgtagttttttgtattttcaaaggttacccacatgtatatctaatactacaaaaattctatttaatctattgtacataatcaattaatcatcaatccagttttaagaatacaaatatacaatacaactctatattctaaatttcaaaaatatgcaacacaataaggaacccttactaggatttagttacgttaatacatgtactcctaaactttatatagatttttccacacaaattttatctctactccatctagcaaattctcaatccacctattttaaggagacaaatatatgatgacacaatctatcaatcttaagtttgatttagtaatgcataaccaagcacataaagaaattactgtaaatgaagcattaataaaaatagatatgctcatgaataactgtattttagaactacaatgcaacaccccaataaaagaaatatcttcgggagatatgtatattattggacctactccagcaattcaagaatggcaaaacaagcaaaataatgtaacatattattacattaaccaatggtactttatacaaccaaatacaggcttaactttatgggtaaaaagtaaaaatcagctttatacatataataatacacaatgggtacctagttataacaactacaaataaaaatacttcattaatttttttagtcgctatgtagaatatgattttactgctgaccttgaagaaaagttggatttaatctctaatgggaagattaattggaaggaagtactacatcaattctggtttctgtttattgataatgttaattcagtaaaaaaactagaatttactgaagtattaaaagttattagttgtgagatggaaaattatattttttcttctgataaatctgaatctagtagagtatgtcctgtatgtaatgatggaacattagagcttaatattagtaagaatggtatttttttaggatgttctaaatatccagagtgtaagtatacaaaaaatgttggaagtggtattgttgatgatacagacaatacacaatatcctaaaatattaggtattgatgctgcaacaggacaagaaatatatcttaaaaaaggtccgtatggtctctatttacagattggtaatgataaaagtggtaaacgtgcagctattccaaaaaatatagatgctaatttattagatttgcaaatggcagaaaaaatattaagtttacctataagcttaggtactcatccggatactggtcaagaaattaagttaggacttggtaagtttggtgcatacatattgtatggtggtaagtatttttcagtaaaaaatgagcataattttttagatattagcattgaaaacgctattaatattattgcgaataattctacaagtggggttataaagtctctgggtatcactgaagataataaagaagtattcttaacactaataatgatattacaaaaaatagatcatgcgttatatgattacttaggggctaagtagttcagtggcatagtaggagaatcataatttctcagtcgcgggttcaaatccctccttagccacttaattcattagcattagagagtccttggtattctattgtggtacctaacattttagagttaatggatgattatacactgagtatcactgtcaacatgatttatgctagcacaatacatgttattttggtatcctattatggtatctgacattttagagttaatggatgattatatactgagtctgccaatattattatgctagctacaatacatgatattctaattattgggccagaggaaagtcagtaggtttatcattgctctacatttgatatactaaccttcatttttttgtcattattgtatttatatataatgtcaagaactaaaagattaaattatcacttagcagtactatattactatttatacataactttatatttctagttataatttttctgatatgagcttaatagcatccgataaagatatttgttcaatatctgtatctttcttcaaagcaacattcaacttatcatattttaaatagaatccatatcttcctttacataagaatacttctttattatcttcagtgatacccagagactttataaccccacttgtagaattattcgcaataatattaatagcgttttcaatgctaatatctaaaaaattatgctcattttttactgaaaaatacttaccaccatacaatatgtatgcaccaaacttaccaagtcctaacttaatttcttgaccagtatccggatgagtacctaagcttataggtaaacttaatattttttctgccatttgcaaatctaataaattagcatctatattttttggaatagctgcacgtttaccacttttatcattaccaatctgtaaatagagaccatacggaccttttttaagatatatttcttgtcctgttgcagcatcaatacctaatattttaggatattgtgtattgtctgtatcatcaacaataccacttccaacattttttgtatacttacactctggatatttagaacatcctaaaaaaataccattcttactaatattaagctctaatgttccatcattacatacaggacatactctactagattcagatttatcagaagaaaaaatataattttccatctcacaactaataacttttaatacttcagtaaattctagtttttttactgaattaacattatcaataaacagaaaccagaattgatgtagtacttccttccaattaatcttcccattagagattaaatccaacttttcttcaaggtcagcagtaaaatcatattctacatagcgactaaaaaagttaacaagaaaaacatttactattctacctctctctgttggaaaaaatcttttttgatttagtataacatactgtctatcttgcaatacagaaataatagaagcataagtagaaggccttcctatccctatttcctccattttcttcactaaacttgcttcattatatctagcaggaggattagtaaaatgttgatgaggtaccacttcatctaaagggcatttatcatttttttgaagtaacggtagcatattatttttactatcatcatcctcaccatgaccatacaccttataaaatccatcaaaaaacaaggaagaacctgtggctcgcaaagttactactttatccagcgaccctaattctactataacctgatcaattacagcagaattcatctgacttgcaacagtccttttccatataagatcataaagcttgagttgctctggagtgagataatttgataaactaccaggagtaattgtaatattcgttggtctaattgcttcatgtgcttcttgagcattttttacctttttcacatacttgcgagcagattccggtaaatattctttaccaaacatagaaacaatgatactcctaatatgctctaatgcttcatctgcaatataaaatccatccgtcctcatataagtaatgagtccaacaatttcccctccaacatcaattccttcatacagtttttgagcaataagcatagtattttttgcagtaaatccaagctttgttgatgcttcttgctgtaaacttgatgtaataaaaggaggataaggattacgctttgtatgctttttctcaacatttataacagaataactacgagatcttacttcttctgacaacttttgtgcatcttcttcattcttaatatcaaacttctctaattttttaccagcataacaacttaaaaatgcagaaaactgcttaccttctgtattgcaacatttagcctcaatatcccaatattcttgtgtaatgaacttttcaatatcactttccctgtcacatattaaccttaaagcaacagattgaactctaccagcagatttactacccggaagttttctccataataaaggagataacgtaaaaccaactaaataatctaatgctctacgtgcttgctgtgcatacacaagatccatattgatacttcttgggcgttttatagattcaagaatagcacttttagttacctcattaaaaaccattctattaattacaacattatcatcaatagcattattttccttcaatacttctataatatgccatgctattgcttcaccctcacgatctggatcagttgcaagataaattccttgtgtttccttattagctacctgaattaacttatttacatatttttctgacttactaataatttcataagtcatagcgaaatctttatccggatcaacagaaccactttttgctggaaaatccctaatatgcccaaatgatgcaacaactttatacttgctacctaaatatttacttatagtttttgctttagatggggattctactataattaaactcattattacaccctaagattaccatttaacaaatccttcttactatgctctatcaatagattagcactattactaacgataattgtgaaaagaattttaaatttattgtagaggtataccagaaaaaagaacaaggtattctacatcacatatatttaaaaaacacttcaataccatactccaccacatatatttattactttttttctatttgacaagagttataataacaacgattactattaattcatttcataaagtaacataagatccatagaaaaaacgtacaacactttacatacatcctctaatatcataaaaaaatacttaaaatgattgaaaacatcatattctacatacgttataattgctcatatacactaaaaaagattaccaatcttaacaaaataatttttttaatacttgaggtatttccagtattatatcatctgcaatcaaaccaataccatacttccttgcacattctgtatgtatccatactccacaacatgcagcatcaaatggactcataccagaagataataatccaccaataattccagataaaacatcaccactacctgctgtagctaaactaaatggagcattatttactacaacattacctataggatcagcaattacagtatccggaccttttaacactatcacagctttcgataaacttgctgcttcccttgccatttctattttaccaccagttaaaaatggaaatatacgcttaaactctccttcatgtggtgtcataacaacattatgttgaattttggaaaaaagaacttcataagaatcagaaaatactgagatagaatcagcatctaaaacacaattttgtttatttaggatatccatagtacgctgtttagtaatatcatttattccacatcctggtcctattacaatagatgtaattctatcatcattaattacatcatcataaagcttgtacataatcgacgttagacaacttgcataaaatgcaacagcattactgtcacaagcaatacttactataccagaacctactctcaaagcagacattgcaacaagttttgaagcacctatagacttattaccaacagaacacactaatgtgtatcccctattatacttatttgatgtatactccaacttaggcattttgtgtttccacaaagcaggagcatttttacgtattacaactttactatcatcaatatcaatgccaatatctacaacatgtacttttccagaataatcacaaccaggaaacaaaacatgccctatttttaataccgaaaaagttacagtaacatcagcacgtattgcacagcccataacctgacctgtatcacaatttataccactaggaatatcaactgcaacaacaactttattattagaatcgttaatatagtgaaatatacacgataaattctcaggtatattgcgcgataaccctattccgaataaggcatctataactaaacaactctgacaattaacaacattatcataagttagtggaacaacccaatcctcatctatatcggtagtacaattatacaacatcaagactactggccagccatgagctttcagtatttttgcagtaacaataccatctttaccattattaccaggtccagaaattattgcaacaggctgttttgggaatagcttaaatataacatcacttatagcctttccagctctacaaataagctcatcaatggccacaccacaactcttttcaaaagaaacaacttgttgaccatttagaataaccataaatgccattttttactaatacacctgaaaggataatatttactaacaaaaatacaagagttatcttaagtgaaattcttcctgtaatgtactaccacacccttccaaattattatgcaataattaatttgatttattcttttttttcttagtttcagcagcaaacttaatacgttcaaattctcttcttttcttgtgccaaccatattggtacattgctattttattttctatcaatgctatagtaccgtcatagtacacaaccatatccatacccttcttctgagcttcaaggaatttttctctatatctatcacgatatgcaggatcattcagtacagaataagtagcactatttgacttattaaaagtatctactacttgtttctttattacatcatgtgtgtaaaaactcattgttattactacctcaccatattaactatattattagttcttatataactatttaatgatgttaattatatcatataactgtaataaaacgatataaaaattattgatatatcacgttttttagaaaaagtgttgttaatttaccacgtaataatatattaataattgaataaaaactcaaattaaattacaatctagattatactattaattcttatcatataaaatggtttcatgcgtaacaaaatattaagcaaaaaatcacaatatattcatgatttgttttcaattacagatacagacgttgtagcaacacatcaacttatcgaggatgatatatccttaatgcaacttagtcttatggaaggccagatattacaattattaataaagatgaacaatataaaatctataattgaaattggaacctttgttggatcatctgctatatgtatggttaaagcattaccaaaagatgggcacatatataccatagaaaaaaacactacaaatgctaaattagcagaagacaacttcaaaaaatacaacttatctaataacataacagtaataaatgacacaggaatatcagcattaaacaaattaactaacatgtcaccatttgacatgatatttatagatgccaataaatcaggatattgtgattacttagattgggcagaattaaatataaaaaaaagtggtttaatagttgccgataatacactattatttggcactgtatactctaatgataatgtaaataaaaaagtatctaaagctacaattaacaaaatgctctcctttaataaaaggctatctgataaaaacaaatatcttacaactttattacctacagaagaaggtatgacaattgcattaaaattgttctaaggattttctcaacttgaatattaatagaaaattaaattatgtgatcaccctctacccaacagtataatattcatatagcaatcttaggcatttatattatcatgtcatcagtaagtattaagtcatattgaaatgaaaaaaagacatactgacaacacacaaaacaataaagtagattttgtaataagaagacatggattgtcagtatgcaagctagccatttttttaatagctccactattatgcatatccagcttatacctttttaatatatacgatagctacataaatataattattaactgcatatttaccagcattagtatattagcaatatcaatacaattaagacaatacttgtatactattgcttctatagaatatcaaaatatgatttttgctaattccttaaatcataatacagaattttgtttaataataaaaaataatggtaaaataatatatgctgatgcaagattctatgaaagatttataaaaaaccaagaaagaaaattagacttatttgatatattaaaattaggtaatatcagtgaacaagaaatcgaagcatttgaaaatgcattaaagaacaagctatcaatcaatacatatttttgtttaaatacaaaaaataaaatttctaactttacactaatattagatccagtattggagaacccagaaatagaaattaactatacaaaaactgtaaatttattttttgctcctcttgcaagaccacaagaatattttgtacttaaagctgtaaaaatcacaaaagaacaagtatatgaaagattaattcaaaaacattgtgtaggagcatatttacttaatcacagaggagtaatattatccgtaaacgacagtttcctaaagatgtttgaattaaattctgtcgaaaatggtactacatttgctaattttttaacaaaaagtgacaacaaagaaaaggtaatagataacaatactgttactctatccacaactacaggaatcacatttaaagcacatatatcacaagctgcattttatgataaaaataatcatagttatatttatgggctcttaactccagtaaattccgatattcttaattatcatttacacccatgtttcacagaagctccaatagctattttacaatgtaatacagatggtaagatcttaaaatcaaataatacactaaaaagattagttaaacacagtaaagaatatatttttgaatatatactaccttcttataataaaaaaattaaaaagtacttccaaaataacattgtaaaaaatatgtcattggaagcacaactctataataactcatatgtaaaaattcattttaataaattcatacatcaaaataacatgtttattatatgttatataactgatagtgaagatcgtaaaaatctagaaatacaattagagcaatctcaaaaaatgcaagctattggacaattagctggaggtatagctcatgatttcaacaatattttaacagcaatcataggtttttgcgacttattattgataagacatactgcaacagatccttctttttcagacataatgcaaataaaacagaatgcaaacagagcaacaaatttgataaagcaattactggctttttcaagaaagcagactttacaacctaaaatccttgacgtaaacaatataattgcagatttactacatatgattaagagattaatcaatgaaagcatagaattaaaaattcaatacgaacaaaatattaatttagtaaaagcagatttatgtcaactagaacaagtaattatcaaccttgtagtaaatgcaagagctgcaatggaaacagggggacagctaagtataaaaacctacaatacgaaaacagatgttttaaaggtactattaaaagacatgttttctccagataaagaacaaatagaagatggagaatacgttgcaatagaagtgtcagatacaggacatggaatggaagataagataatgaaaaaaatctttgacccatttttttcaacaaaagaaacaactgctggcatagggttaggtttatctacagtgtatggaatagttaaacaaacagatggatatatatatgttaaaagtatagtaaattcaggtactacttttattatccttatccctacagtacatttatcaaataataacgatattgaaataccatataataaatattcaaatgaaacaagcaccacagtaccagaagtcaatacttctacaactattttactcattgaagatgaagatcctgttagaatatttacaacaaaagcattgactaaaaaaggattcaaagtcatagatataaattgtggagatcaagcattagacataatcaataaatatcctatagatattgttatcagtgatgtagtgatgccaaaaataagtggtccagaaattgtagaacaaatactaaaagtaaaaccaaatattcaaatcatttttatttctggatatgctgaagaagtattcaataaatacagcaatatagatgtaagtaaaatcaatttcctatctaaacctttcactcttaaacaacttacagaaaaagtactagaaatatcagacaattctttcttgcagaattaaatataacctttattacatacaagcaatatttagctataaaacttgatctaaactcgtttttacaataaaaaccataatatctaaactacaataaaattatatatgaaaaacatctctttactctatactactactcctacttacgaagatgcataccgcataagcaatattctgttagaaaacaagctaatagcatgtgctaatatatttagtaacattacatcagtatatgtctgggaagatgaaatacataacaacactgaatgtgctatcatattaaaaacgacaaatgacttagtccaacatgctacaaataaaatacaagcaatccacccatatgatactcctgcaatcatcacaatagatccaaccaatgcaaatgacaaatttatacaatgggtaaatgactgtactgctttataagcttgctatcacataaaaaagaacaacacacaataaaaatactagagctctaaacagatatatacttgctaccataatatttcaatcatacaactgtctatatagtagagaaatctacttataagtttactattacactagaaaaaacaagaatttaattcaagaattgtagaaaataaagagttcactttcctatacactatagtcattattataatttcatcagacaataagcttatacaggaaataaatccactaataattgtcaaaagaaaattcaaagtattttagcattaaaaattatccaatcaggacgtgtcatctgcaattttctagctgcatcttcagcatgacttaattcattaaataaagcaaaacaagttgctccactaccagtcatacgagcaattacagaattttttaattgctttaatacaaataatatttcttctatctcaggaacaaatttcaacgctacttctaataaatcatttttagcattacaaattaattccatccaatcatcttgctttacaggaagcttatcacatatggaaggagagtaagtagcactctggtaattattaaagacctttgctgtacttaacgtctttccccttggagcaacaagtataatatattttggcaataacaaatcaggtaataacaatatatcttcccctacccctttagcaaaaagggtctttgattccaaacatgctggaacatcacttccaatttttaaggctaaatcctgtaacaatgtgtaatcaatgttccacatattacctagtaaacgcataatagcagcagcatcagctgatccacctgctaaacctgcagatactaaaatattttttataatactcacagaaacattaggacatacagcactgtgtttcaataacaactctattgctttatatacagtattattatatttgctaatcctcagatttgagaaatatactccccgtttcgaaccaccaacatcaacctctaagatatcgtaaacattaacaaagacaaacaatgactctaagtaatgatgttgatcactccgtttaccagtaatatgcaaaaataaattaacttttgctggtgctttaactaaaaactttaacataattatattatcattaacaatatactatacactattaatagtgaagactacatagcttgtaaaatatctttagtgattattaaataaaaaatccttttaataaattttaaatacatacacactgcaatatataatataaatattacacatcataaaatattatatcatcaaattagaaactttttattataatttacttttttattagtgaagcttattatttctttcagaaaaaactatattagacaaagatgtaggacttcgtagactctgagttattcctggaagcagtattaagcattatctataatatatactaaaccagattataatggatggtcggtattttaagattttataatatatagtataccaagtacttacttattactaatatttactttaaaatacagataaaccaataacaaaagtagatcctttctataaaattatatattatattgatagtgttttttacttacatcaaaatataataaactcaaaatattaaaacatatggacattagccaatttatatcagattatccagtaatattagcaccaatgtctggtgtaactgactttccatttcgttaccttgtaaagagccttggggctggattattagtatcagaaatgatagcaagccgtgcaatgattatacaaactaaacaaagtttacaaaaatcacaaattcaaattaacactgcagtacaacttgccggatgtgatccaacaataatggcagacgctgctaaactcaatgaagatatgggagcacaaatcatagatataaattttggatgtcctgtaaaaaaagtagtcaacagttacgctggttcagcattaatgaaagatgaaactacagctgcaaaaattctagaatctgtagtaaaagcagtaaaaattccagtaacactaaaaatgcgcactggatgggacaacaataacttaaattcacctaaattagctaagattgctgaagaaactggaataaaaatgataacaatacatggcagaacaagaacacaaatgtttactgggaaggcagattggaaatttatcagaaatattaaaaaatgtgtaaaaattcctgtcatagttaacggagatataaaaaacttaaatgatataaaaacatcactagaagaatcacaagcagatggaatcatgataggaagaggagcatacggcaagccatggtttatcaatcaagctttacacttcataaaatcaggcacaattttacctgatccttcaccatcagaaaaattaaaaattatcacaaatcattatgatcatatgatagaatactatggaaaagatactggagtaaaaatatcaaaaaaacacataggatggtatagttcttctctagagaattcatccgagtttagatctcaagttaactgttctaatgattacaactttatcaaagacaaaataacagattttttctcacaaaattaatgttgtactgaaaacgcttgtatacaaaataacagtagataattaccacttaatgtatacaaatggcaaccaacaactaataacatattacaaattattttttttaattcaaaccttactagaaatgaaattatagatttttcacaaaaccagtgttttatacaagaaaaacattatatacttccctaaaaaaaagaaaaataataattgctattttacatgtatatttgacaatattacacatttaataaaattttaaatcatgtaaatcactaaaatttatcggaaataaaaaatgcttaataattttaatcaaaaaattattgattcgattctagaattaataaaacaagaagacgactgcttatttaagagctttgttaaacaattctacagtttctcttatgatagcgatattactttagatactaacttttttctatttataacacgtgatctatattaactcatcaagatcaaacaacccagagaaagtaaagttaaaatattcaacatagaagaacaagataatgagacaataagtaacgtaactattatcgaaataataatagattttttcacaaaacatgtattctatacgaaagataatctttgtttaaacaataaacaaatagctaattgttcttctcaatatatatgtcttataacgttttgtaattgacaatgtacttatagcatgatatgaatccaagtttgtcgtttctgaatattattagctatgaaagatctacaaacagataaagaattactcagaactcttgtgagtaagggactcaaacaaggatttgttacatttaacgatatcaacgatgttttttctgactacgtgctgtcatctgacaacatagatgaaactatatcaatgcttcaggattcaggtattaatgttcttgaacaaagtgatgaagacgaggcaaatagcataatagaagaaaacagaatcaaagatgaaatggacgaagatgatgtatcagacaccagtataaaatcttgggattttggacaaacagatgaccctatacgcatgtacctatgtgaaatgagttctgttgaattactatctcgtgaaggagaaattgaaattgccaaaaagatcaaatcagaaaaagtaaatatgctcaggtcactagtagaatccccaatagtattacgtacatttatgtcatggagggatgacttagtaaatgaacaaataatgttaagagatttaatagatttagatgcaaattacaggtatgaatttcctgaaaaattttctgacactgatgatgctagtgttttaggttatgataaagatttaatggatgaacctgatgaagatccagatataccagaagatgaagatgaagaaaacatttcaataaatgcttcaatattagaaatggaaaatgcattgctacccaaagtagtaagcatcttagattcagtaattgcatcagcagaaaaaattttagaactcaaaaaacaatatcaaggtaaaattaaccaagatattgaaaaacaatacaatgacttacacgatagcatatgggaaatgatatatcaaattaaacttagtaattccgcagtcctatcaatcacacaacaaatatatagcttaagtaaatcaatagcagcagaagaggcaaaaattatttcccttgcagaaagctatggtatacaacgcaaagacttcttagatgcatataatactaattctgtattgcaaaaaaaaggcacttctcctcaatgggataacatgttactcaatgaagagagtaatatagtaagtatgtacagtaaaattaagctactgtctggagaaaataaccttaccgaattcaaagcattagtcacaaaaatacaaaagcacgaacgtgcagcaaatcaagcaaagcaagaaatgataaaagcaaatctaaggttagtagtatcgattgcaaaaaaatattcaaatcgaggtttacagtttctagatttagtacaagaagggaatattggcttaatgaaagcagtagataaatttgattacaaacgtggatataaattctcaacttatgcaacgtggtgggtgaggcaagctatcactagagcaatagcagatcaggcacgaactattagaattcctgtacacatgattgaaacagtaaataaaatcaatcgcacactaagacaaatgctacacgaaatgggtagagaaccaacattagaggaattatcagcaagattaaacattaatgtagataagatacgtaaggtaatgaaaatagttaaagaccccgtaagcttagaaagccccataggagatgatgacagtagtacctttggtgattgcatagaagataaacgtgcagtaaagccagaagatgcagcagtacttgcagacttacgagaaataactacaaaagtattatcaacattaacaccaaaagaagagagaatcttacgtatgcggtttggaataggtaaaggtggaaaagaccataccttagaagaagtaggaaaactattcaatgtaacaagagaacgtatacgacaaattgaagcaaaagctttacgtaaactacgtcatccaagtcgtgcaagaaagcttagaggatttttctaaatctatctaataatgattaatttgcaaaataaacacaggttttaactgagaataattacatatataacaaaactttagcgtgtttattaactggataactaatgattttttagtgttatagattaaaaccatcagtaaaatataataaaaatcaaagacacattcatcatgatataaaaactgataaagaactaagtctctaacaaaaactcatataacttttggtaacatatcaaaattaaaaaacacttcaaatcatgaaagcattaataaagtttctctcaaattatcactaactatattaattataccattatatagacattacttctcaagcgtaaaccacatcacataaaaacacatgagttaataaaaaaaactatctgtatcctcagtctaagagcattaagttataaaatacgcaatacctcataactacctctcattcttaataattccataattctcttaatctattatctatttcctgtgcttgattagatagtctttctgcaagatccctttgccccttcaagcgtaaatctaatatctccttctgaatacattgcaagtgatctaaaagcattattttttctatctctttctttgatacatctacactatattctctatcttgtaataccataaaattagatgtagacattcttttgataacaaaatttactatctcatctaaattatttttctttaattctgaaagtaagacctccttagatataacatgattacataaagtaacttttatattaataatattctgctgcaatacatatatattcttatcacttatattaaatttagaaaattgatcaaaaataatcggatcgtcaagcagttctggaaattccataatcacgtataccactctcaattgattatactcttccaaaaaaaattcatcactcacatattttaatctattatctaccttactcaccggattatcagtactcaaaaatttacttttatcttttgaatactgcaaattacggatttgagaataaaaatactttttataatattttacaacgttattatcgctaatctggctaagataatgcttaattcttgcttctaacatgacacactgttcaggcataatagaattcttattaacattaaccctagcaagttcataatcccaaataaactctgatagtaattttgcactatccaacaaagcaattacactatcaacaccatcatttatacaaatatcataaggatcctttcctgtaaaaacatcaacaaattttattatgcatccaggtctaattaaagataatgcaagagatgcggatttaatagaagccattttcccagcaatatcaccatccatccacactataatttccgaagttatttcccacaaatacattacatgctcagaagtcattgatgttcccagtaatccaactacattgctaatacccatttgatgtagcattagaacatccatatatccttctaccactataattttcccctgcttttttgcttcacgcacggcaaaatgcgatgcatatagattttctcttttttgaaaaaaagcacttcccttagaattcaaatatttagggttctgtgtactaataattgatcgaccaccaaaccctataatatttccactagaattacaaataggaaagataaccctattgtagaaataatcttgattttgagaatttaataatcctgtatttttaatatcatctatattaaatcctaaagataataaatatttacccaaaccatatgttggagcataccccatcctaaatttttttactgtatcattagaaattttgcgactccttatatattctattgccacatgattattacgtaattgttcttcaaaccataatgttgcagcatccaatataggagttatacttgtcttattattagtactttgtggcaaatcaataccatatatctctgccaagtaatttattgcacccttaaaatccaaagcattaatatcagaagtaaactgtataacatcaccatttgccccacaaccaaaacagtaatataatcctttttcatcattcacagtaaaagatggcgtcttttcaccatgaaacggacatagtccaataacactattaccccttttagttagcttaactctttgtccaactacatcagataactttattttactcttgataatatcaataacattcatgtcacaactatagacagcctgattcttctaataataaagcatattacttcttataataaatagagccataatttattatacaatcatagaaggttattacaattaaatccagatttagactaaaaacattttttatggttatgtgagattaaaatgtaatatggagtacagcacaccatttttttaaacagagtctgcatacatccactaataatatgaaaaaacattattgataactactgattgttatatcaataaaacatacacaacagcatgagtaagatatgaataaatagtagttagataaaactttgaatagaacaaaaatatactcgtatcattgcaaaaaacatgattaacaatatggaatacagcacaccactttttaaacagagtctatatacattcactacaataatataagaaaaacattactgacaactattgattattacatcaataaaacatataaaacagcatgagtaagatatgaataagtagtagttagataaaactttaaacagaacataaaatacacttatatcattgtaaaaaaacatgattaacaatattttattaattatagttcaactatggatttaccaaaaatactttaaacatactacccatattttcagtcaatctcaaaaaacctgctattaaattttgtttttgaagctccgtagcatttgcaatcagtacttgcagcctttctttaataccaaaattatataaaaaatccctttgcgtcataatcactgaactgagagtagacaaactgttatgtaatacagcaaaattcacatatgcagttatatcactttctcccacattcttaagtaaattattatactgatgattcttgacagactgtatagtacttttatatggacaatctatatatccataatcaataaccactgctgcaccaccactttgtagaatcttattttccatacattttactatagaaacagcttcatcacatatctctattactggatttttcatgtcatttgacatttcaaagatcttatttacttttttataggcaattttaaattcatcgttctctactgtaacatatgtttcacaccaagaatcattggtatacacaaactgtttaacaggcaaagcatcaaaaaactcattagctataattaatacaggataatctggtaaatcctttatatctttacaccagaacactttttcatcttttaaaacatctcgctgcaatttttctaatatagggcttatttcaacaagataaacaaccattgctgcgtaacattgttcgaattttctcaaaactctaacaacatcacttattaatgttcctctaccaggccccaattctactataataaatttagatggagaccccattttttgccaatttaacaatatccataatgcaataacttctccaaacaattgagatatatcaggagcagtaataaaatccccataagtaccaaaaggcatttgtgtcatataatagccgtaatgtacatcataaagggcaattctcataaactgttctactgaaatagcacctccacaatcaaatataattttttttaagtaagaatgcataattaattaatgtattatttacgttaatatgatataaatagtaaaatgggttgtaaatttttaatattatgatgttatctattttcaataaacaattaagcgaacaatcctcaaactatataggagatggtgtttataatttatgtagcatgttaacttccattaaaaataaatacaatccttacaacaaagtaaatcaaccaaacatcaatctttcctttaccattttacataaaaacgatacaaaaggtacaatagatcaggaatatggcaataacataacacataatacattctctaatggtttaggtacaacatctataaatctattagataaaccaacaattaaagaagaaatactatcacaagataataacaattgttatgatgtcacaacccaacaatatgacaccaacaatatcacactgcatagtgaagaaattagttacgaaatggcatacagtttattgctagatttagtaaataatgacattgaattgcttgaagaagttctattaattgcaaaaattttaatcaaagaaggggtcttggttgctccagaatccaaaataaaaaaggatattgctcaaatagttctccacaacataagtaagcaaacaactcaaaattcaggttattcaaggtaaatgagatgccaggaataaagaaatttattgttccatgtgatttcaacggacagagttctccctttgcaatatatattggagaaccaaaaccagaaaaccaccctgtacaacaccaagataactggttagcaaaagaacgtggaggtaacataccagaaaaaattaaagatagtttagcaaagttacatgcattagcacagaaaaatggtatttgtttcgcagatctttgtgtatatgccttaacggtcgcttctcataaaaatactaaaaactcctaaaatatattcatttcatttacaacgtatactcttgctatagaaatttacgctttataatgcaaaacatatttttgaaacaatgtgtaatcttaaaaacagttcaacataaccacacaatatatggtatttgtttcgcagatctttgtgtatatgccttaacggtcgcttctcataaaaatactaaaaactcctcaaatatatttattgcatttaaaacatatactcttgctatagaaatttatgttttatatgaaagacatatttttgaaacaatgcgtaatcttaaaaacaattgaacacaaccacacaatatatgattattatttaaacaatacaattgataaatagcccttatttgtatctctatccattacttagaaagatatgatattaaagcatgcattacaatcatacttattattcctaaattttatatagaatccttttaatacaataccaagacctcatatacagaatcccctaaagtttgaatataacaaacttatacattattttttacagaagtaaaaaaagtccagattacattaatacaattctatataccttaaaatgactttaatatcaatgatcttcaaatgcttcttcccatgttccttctgtagcagcacgagcatattctgtaactctattttcaaaaaaattagtatgctctaccccatttaaaatttcatccaaccataataaagggtttttatttgtatcatatataggttctagatttaattgcaataatcttctatttgcaatatacctaatatattctttaacttctttagaagacaaaccttcaacatctccacaagcaaatgctaagttaataaactcatcttctaatgaaacaattattctgcacgcttcatataattcttgttttaatgaatcatcccatatttcatagttctcttgaataaaagtattaaacaatctgattattgattccgtatgtaatgtttcatctcttacagaccaagctataatctgtcccatacctttcatttttccaaaacgttgaaaatttaataagattgcaaatgaagcaaacaactgcaacccctctgtaaaagcaccaaaaactgctaaagtttttgctacatgtcttttatcatttttcctacattcctcaaacctttgcatgtaatcatatttcttcttcattacctcaaattttaaaaatgcttggtattcaatttcaggcattccaatagtatccagtaaatacgaataagcagctatatgtatagtttccatatttgaaaatgcagaaagcatcatacatacttctgtaggtttaaaaatatttgaataatgtttcatgtaacaattgttcacttcaatatcagcctgagtaaaaaaacgaaaaatctgaactaaaagatttttttctttttccgaaagcactgttttccaatcctgaacatcatctgcaagtggtacctcttcaggtaaccaatgtattctttgctgacataaccaagcatcatatgcccaaggatagttaaatggcttataaattggcctagaatctaataatgacatctctaagtactactgaacaaaaaaacaacatggatcacaagctaaatccaggaaaactataacaactatttaccataaaaatcaactaagatttttttactaaacataataaatacaactatacaaaatattatgtacttataatcttaatatacttatattatattttgactaaaaatattaaaaaaataatttgcatattaaattatttacaattatacagtactgataaaattgtatgtgtaataatgctatgctaacaaaagttcaacaaagagcagcaataaataacataaatttaaagcagtatataagggacatcacattagaaaagattgatgaagctctcatagatatcagcaatgtaataccattatgtatagcactcatgctagatatcacgccagattttacttccttcagaaacgaagtaacatctatgttagaagaatataaggaatggtttattgcaaacggggaagcaaaaatgcccctaattgatgatagaacctcagacactttatggaacagtataaaagaaatacacacattataccacaaacaccaaatgtcaatttctagcaacgatggcattaatattctagatagaatcgcatttaactctgctcacaacacgcaagatattataatagataataaattaaagtataaaattcaatatatcatactgtcatcattcattgatcaatgctttgatactgatactaaccctacaacaatatacaaaacggaaattctactgctaacatctgaaattagaagtaagataacgaacaaattaaaaacaacactatttcagtatgtacaaaaaaaagctttttcctcatatgcagaacatttacgaaatttatataatatacaagcatcatatgtaatagaaaaaaacattgacttattaagaacagccgaacaatttattgggttaaaatcaattcatattttgaaccaaagaacattccgtaaaatcaaccttttgctagacagtggatgcgaaatcaatgttaaatgcgatattccaacatacacagagatatttctagaaataagtgacataactatcttcggcacagtatacggcagcatcttcaataaatatggtagcattactattattgatgcaaaagaagaatgtagcaaaaatatattatctatattcggaactgtaagtatcaatggaaaaataattaagaacaacttacctgatatatttactattccagccaatttctgcagaaatataaaacataaaaccataataactagacaaacagatctctgccaagcagaaaaagtaataacatcatttcatccatgtgatgttatcaatcaaaaagatccaaatggaatacgtgcattaaacatagaactattccaccctaattttcaataccacaccgtcattgcatccataggatggcctatcaataaacaaaacaatacctcaactgaaaatgctgaattgctatttcataatataatacataatgcaaaccacttaaacataatagacaacatcagtaaaaatcagaggctaccaaatactttttttaatgatagcattcctatgtttattcataatatacgtataacaaataaacaattaatcattgaaaatttaagcagtaatatagcactttacttaacatacataacacacagtggtacaaatcttacatctaaatttggtgttaatgaagtaataatacacagtaaagctgtagatttttcaattttaatacttcatgatacagatgtaaccgtatttggtaaattttgcggcttattacatacaaacaaaggtaatattacaattgtaggacaagttagaaaatcgaaaattatatcaaacactggattgattaaaatagaaaataactctcttaatgctacaattccaatagtaatagatagttctataatcgcacaatatggtgcagtagaaattactgggcaatgctccaattcttatatagatagtaataaagtaactagaaaattaccaaacaataccagtactccaccttcatatcttacaagactttcagaaatattttctgcacttacaagaacaatagcaagataattatgacattatcatagtacaaaccataataaaaagattctaataaaaaagtgtgtatcactaaacacagtaaaatttcagtattagcaaatatttacttcatattttactataatctctgtatatgtattcaagataaaactttataacgcagagttataaaaaaattcacttgttattttattatttcttataccaatgcgtagttccatctttattgtcagaaagaactattccacgatttaataaaagctgacgtatatcatctgcccttttaaaatcattattggctctcgctttttttctttcatctatcaattgacttatttcttgattattatcatcaattttaaaccaatcttgccaagaatgctgtaagatacctaaaaaatttgcagtcttaataagagttttcgttaaagatatcttttctatcatatcagctgttttattaatctctgtcaccatttcatgcaacattgaaatagcttttggagtattaatatcatcttttaaacaatcaataacatgactcgataactctacactatcatccaacgataaatcaacatttgtagaactcaaagcagtatacatacgattaagtgattcttgagcactagccaccatttgactattccaatctaaaggttttctataatgagtactcaataacacataccttatcaattcacctgtaatcccactattcaataactgcctaactgttaaaacattacctaaagatttactcattttctcatcattaactgtgagaaacccattatgtacccaatatttagcataacggctatcaggaaaagcacaacaactctgtgctatttcattttcatggtgaggaaattgtaaatctgctccaccaccatgaatatcaaaattttcctttaaataacgataactcatagctgaacattctatgtgccatcctggtcttcctaacccccaaggacttgaccagcaactcattaattgattatctatttcagttgcaggcttccataatacaaaatcccctggatgctttttacctacctctatatctattctactaccataaataagttgtgagatattacgcccagataactgaccataagaagaataagactctatattaaagaacacactaccattatatacatacgcatgaccagaatctaccaacttctgtattaaacttattataacatctatgttgtcagtcgctcttggctcataagtaggttccaaacaattcagcattctcatatcttcatgaaacgcttttatataaattgcagtaacatcatatatgctttggttagtattttgtgcaacattaataatcttatcatcaatatcagtaatgtttcttacatacgttactttaggatatagcaacttcaataacctaaacagcacatcatatataactactgacctagcatttccaatatgtgcaaaatcatagactgtaggaccacaaacataaacccttacattatcaatgctaaaaggtacaaaaggttctttaatgccagttaaagtattatatatgatcatgtaaatttagataaaaaagaaaacatacttacaacaagtttgggacccagaataactaccataagagtaacaataataccaaacaatgatactattactccaagaatcaccatcacaccatctttattaagcatgcccaaagacataattgacacaccaccagctggtatgaaattcgttaaaggtaaaggtatagctattgatatagcacatataagagaaataaaagctataactttctctccaaaactattaaatataaataataaacgaggctttgtaagtttttctgcttttcttaatataggagcagttttttcaataattaaagctaatgttgtacgtttgaaagactttttttctaaccatttaggcatccaaggagcttgcaacccaagcaacatttggaatgcaaacattaataaaggtattgagaatatcgttgtatatcctggaggaacaggtataggtattgcaagaggtaaagaaaataataacatcaatactccaaaaccacgagcatgaagtgcagattttaactcaaacaatgtaattttgtctacatcagcgttacttgtaacttcttccaatagatctgaaactgctttatttttttcgtgcgacatatatacaaactcatttcaaaaactatataacatacttttaagaaaaataacactgtataattaataaaatttactatacatttttactatctacaagtagtaaaatattatttaacaaccaacacatctaattaataataaaaatctatacaacattactttagaaacaatatcttaatatttttactcgccacaaataaaaccacaacaccaccaagaaatcaagtcatagtactattttaagtaattttcataagttaatattcaacataaaattcttagttatcaattgactataattttatataactgatagcatattctagaagtaaaagattgataatatatttaatttattttgatacacatattatgttatctagcactaacctacaattcttgtcctagtatgatatatcaatatcttgtaaataatattccatagtatcctaattcttaaattcaacagtatcttaaaaattaattgcattatactttaaagaagtataatagtattttaacaaaaataatttactattatcattgtcaactatcgcactaaaaaaatgcttaataattttaatcaaaaaattattgattcggttctagaattaataaaacaagaagacgactgcttatttaagagctttgttaaacaattctacagtttctcttatgatagcgatattactttagatactaacttttttctatttatagcacgtgatttatatcaactcatcaagatcaaacgacccagagaaagtaaagttaaaatattcaacatagaagaacaagataatgagacaataagcaacgtaactattattgaaataataaatgataacctaccatttataattgattctattattattgcaataaaaaaacacaatgcatcaatatatcattatacaaatgccgtattaaacattgaacgaaaagaacaacatatacatgcaatctcacctgcacagtcttgtttaaatgatgaaacaagtgaatcaatagtatattttattattagcaatattgacaaagaatcccataaatccttaaaacatgatattgaaaaaaatttacaattagtaggctattgcgttaatgactggaaatcaatgttacatcattttgattcagcattgaacgttatgaaagatctttatgataattctatagaagaagaaatcacatttttagaatggttaaggaaagataacttcatctttttagggtatgaagaatacattgtagaccaacacaaattactaattaatactaaagctaatcttgggttacaaaaaactaatacatctgatgaatctagtaaaaatttatctaactctacagaacatgtatatattatacaatccaacattttatctacagtacatagacatgaatacatgatttgtgtcggattgaggatattcaatcaggataatattttggtcaaagaacattgtttttatggtttctttgcgtcaataatttcatttcaagatgcaaactctattccattgattagaagcaaaataaaagctgtagaaaagagagcaggatttactaaaggtgggcatagtaataaggcactgattgacatcttacaaaggttatctagagatgaattatttcaattttctgaagaagaactattcgaaatttcaatcggtatactgtctttagctaataacccaaaaattaagctttttataataaaaggtcagagtcacagctttgtaaactgcattatttttataccaaaagccttagcaagtactgaacttgcaaataaaatgagctatatattagagcagatgcttacaggtaaagttgtcaataatcaatataacatgttaaacgaatataacttagttagattacaatttatactcaaagcacaagataagttatttagtgatttttcggaattagaaattgaagaaaagttaatcgcagcatctagaagatgggaagataaactacaagatgttatgtgctgcaatttaggatctataaacccatttttacaatatctaacagcatttccaccaagctatcaagaatattttaatccaaaaagcgcttaccatgatataataaaattagagcaagtttgtaaatacaatactagtgaagctgatctttacttgataaaaaatagtgttcactatcagttaaaaatatatatacctcaagaaagtaaccttcaactttcaaaaatactaagtatagttaaaaagatgggaacaaatataatcctacaccacagctatactattacagcaaaaattactgtatacctacatcattttatactgtcaaatactaaacaatcttttgaccataacagtatcaaacaacaattcgaaactacaattaaaaaaatatttgctaaagaaatagaaaatgattacttcaatagcttagtcatattagctaacttacactggaaagaagtcatgctaataagagcactaagtagatatttaaaacaagtatcatttaattatagtcaaatttacactcaaaaagttgccataaaatatccaaaagtcttgtttaattttataaaactatttgaggctagatttaatccagaaatggctaatgatcaagaatctcatgctatagaaaataaaattaatgaactgttactagaagttacagatgtagttcacgatcatattctacggtctatatatgcgctaatcctagcgattctgcgtacaaattattataaagataaagattatttatctataaaattagactcaagtaaagtaccaaacatacctttaccatgcccttttagagaaatatatgtatactctaacctatttgaaggtatacatttacgaggtgggaaagtagcacgtggaggaattagatggtctgacagaactgaagattttcgtacagaaatattaggactaatgaaagcacaaatgacaaaaaattctgtaattgtgccagtaggatctaaaggaggattcatcttaaaacgtgcaccaaaaaatgcagctctactaaaaagtactgctgtagagtgttataaaaacttcttaagaggtatattagacattaccgataacattattgatgacaaatatgtcacacctaatgacattataaaatatgatgaatacgatccatatttagtagttgcagcagataaaggaaccgccacattttctgattatgcaaatgaaatttctgaagaatacaatttttggctaggggatgcctttgcatctggaggatcaataggatttgaccataaaaaaatgggtattacagctaaaggagcttgggtaggagctcaaaggcatttttggcttatggataaagatatatataacgaaccatttacagtgattggtatcggggatatgtctggagatgtattcgggaatggaatgttattatctaataaaatacatctcattggagcatttaatcataatcacatttttattgacccatcacctgatccagaaaaaagttttcttgaacgcaaaaggctatttaacttaactagctcttcctgggaagattacgataaatcatgcatctcaaaaggtggaaaaatctttaaccgcaattctaaaatattggacttaacccctgaaataaaagaattatttaatattagtgaagatcaaatttttcccaatgaactcatcaaacacttattaaaagcagaagttgatatgatatggaatggagggataggaacatatatcaaatcctcacaagaaagcaacgccgtagtagcagacaaaactaacgacgcactaagaattaatggctcagaagtaaaagccgcaatgataatagaaggtggaaacttgggatgtactcaacttggaagagttgaatatgcacacaacggaggaaagatcaacactgattttacagataactctggaggagtaatatgttctgactttgaaatcaatataaaaatatgcctaagactagcaatgcaaaacaagtacatttctttagctgaacgtaataagatattagatgatataatgcatgaagtaccatcaatagttttagaatcacacaataaattagaaacaaaagctttaatgttagaatgtatacaagcaaaaaatagaatagaacaacatcataggctattaaaatatttagaaaaaattcaagtactaaaccgagatatagaatttttaccaagtgatgaagaaatcacaaaaatgagtgctgaaatgaaagggtttacctgccctcaaattgcaatattgatagcatataccagaacatttataaaaaacgaaattatgctttccaatatctttcaccattcaagcaatttatcaagtttatatgaatcccaatatctgctctcctactttcctcagtatataagagataactttgcacagtatataaggcaacatcctttaaaaaaagagatattagcaacttgtatagtgaacgacatagtaaacagaatgggatgcatttttgtcaatcacattatcgaaaatattggaattaccgttgaagatataattaaaatatacgtcataacaactcacatatataacttatatgaaatatggaaaacactagatgaactagatagtaaagttcacattaacgtatatacttccttaattagagaagtacaaaaattcataggacaagttactttctggtttcttagaaattcttctaaaattacaaatatagacacaaaattagatgagttatcatcacaaatatcatcacttgaagaaaacatagaaagtattttatgtaatgaatctctagaaatatacaataatactttatcctctttaagcgagcataatattgaagaatcaattacaaaaaaaatcataaaattaaaatttttgactgtttcccttgatataatacacctaacaaatagttcaaatttacctttattaactgtaggaaaaatatacttccagctaagatcattattaaactttagccgtatacgtgaccttgcagcacacatggaatcaaactcttcatattggcaacgcatcgctattagaaatctacttgatgacttaaatgactaccagtttataatcacagaaagtattttaaaacaggtagaacctacactatcattagcagtaaaattggataaagtacacagcataattaatgacataattcaaagttggtatatcaaaaatcaagaaaagctgaacagatattataattttttaaatgaaataaacacaactcaacttgatttaagtaaattaatgcttataataaaatctcttgatatgtttattaattaaaacaattccaaatgtttagtgttggtatatcggaaattattgtcataatcctagtagtatgcctagtaattgatccgaaaaagcttccctttttagcaaagaacttaggagtttattacaaaaaatttatagatacaaaaggagaagtgcttaactattttaataagttttacatggactgcatagaagaacaaaatgataaagtgactattaaagaaatagtaggaaatgatggaaaagtatataaaagttatgaaataaaaaaaatatcaagtaaaaaagaagacatatgactgcaaaagtattaatagtagatgacttacctgcaaatataaaattgttgcaagctaagctcatgagtgaatattataacgttctaacagcaacaaatgggatggatgcaattaaaattgctgaagaaaaacatccagacataatactattagatgttatgatgccagaaatggatggatatgaaacttgcaagagattaaaatctaatccagaaactacatatattccaatagtcatggttacagctcttgataatacatcagacaatagagttagtggtctcagctatggcgcagatgatttcttaacaaaacctataaatgacacagctttatttgcacgtatcagatcattaacaagattcaagatggttatagacgaattacgattaagaggaaaaacaaatgcagatatgagtttattacacaataatatgatggactatgcaaataaaattgacgatgctagcatcttaattgttgatgaagatatgataagatctgagcatataaataacgttttacaaaagtctttccaacaaactgtagtttcacataatatagatcaagcattaaccctaagtaatacacaaaactatgacttaatcattattgatctagaattttctggagatggattgaggttgtgctcacaactacgtaacaaaatagaaacacgctatactcctattctagtattacttgatgaaaatgaggatccaaaattattaagtaaagcttttgacataggaatccacgactacattacaaaccctatagacagtaacgagcttattgcaagggtaaacgtacaggtaaaaaggaagagatatcaagatgctttaagaatcaatgtagataacagcatggcaatggctataactgatcctctcacagggtgctataacagacgatactttgatatgcattttcataacatagtaaatgaatcactacaaaaagataaaaatctatctttaatgatattagatattgaccattttaaagaagtcaatgatacatttggacatactgttggagatgagctattgcaacagtttaaaaaacgtgtatcagacaatatacgcattacagacctattagcaagatttggtggagaagaatttgttgtaatattaccagatacaacaattactacagcagaacaaatagctacaagaattctttctgtaatagaagaaactccttttaaaacaagtataggtgatataaacaaaaccgtcagtattggtgtagttgaagtacaacagtctgacattaataatataaaacaactagtagacagggctgataagtgcctatatgaagcaaaaaatacaggaagaaacaaagttgtcacatatctatcatagacaaaacgttgtttatagtacttgtactttgtaaatcatatttgatttacaaagtacctacacatatcacatatcacatatcacatatcacatatcacatatcacatatcacatatcacatatcacatatcacatatcacatatcacatatcacatatcacatattaagattataaatacttcaatgtaaaaaaacataagattttaaaatatacaatgcattcataacatcgtataattacaaccagaaaactttatatgacttttacatatttgcttttaattaattagactccccccaactttaagctttacttgtagcttagtaaacatatatattttagaatatctatatttatcaataaactacttcacactctatagcaataaagtatatttaagcagtaatatagtactttacctaacatatataacaacagtagtacaaaccttacatctaaatttggtgttaatgaagtaataatatacagtaaagctgtagattttcaacattaagtctatacatctttatgagtaacgtaagttacattaatatacaatttataacaatttctctaactgcataattgcatctttcatataagatggaacaggaacagtaaagtctatttttttttctcctatgttaatcgataaaaaatatgcatgtaattgtaagttatcatttaatacatgttcacaaaattttccgtatttcttatccccaataatagaacatccaatatgtgaaaggtgtattctaatttgatgttttcttccagtaataggtttcaattcaagtaatccaataccataaggcaatttcttcaatacagaaaacgaagtaacagcttcttgtaaatatgaatcattaactttatctaaagaaagactacgtttgtttttaataatagaatgattaatctgtccaatatcattctttggaatcccttgggttaatgccagatatttcttttctacccttctatttttaaactcatgcataattaatctggatattcttgcattacgcgctaacatcaaaataccactagtatctttgtctaatctatgaacaattttcatagattctccatctctaattttatcaacaatatcactaatactaatcttaactttagtaccaccttgaacagaaatgcctgcaggtttattaataatcaacacgtcatcatcttcatatacaacactattacggatcaaatgaactagaaaatcactatcagctttacaaatttttctaatttgtttcctttcataaatgactctatcatatcttacacaaattacatttccagctttaattcttacatcagacttcacttttgtattatcaagtagcactacacctttacgtaaaaatttctcaactaaagactggggaatttttaatatccttctaataaacttatctatccttatattatgatcatcttcctctacgatataatacttactcatcactatccaaacttttaaaacaacatacaaagaatcactaactttcaaaaaactctaaatctacacgtaaactaaatatatattgctgcacattacctactaatttccattacgtctactattacccatggtgatctaatcttttaaatagcatcaccaactctttaaaacctaacctacactaaagctaaacacagatttaaacaaaacattcttcagtttctattaatatactattctatataaagtaaattctttacaaaaaaatcacatgatatactaactactaaagcaagcatccaattttacaaatagatcataaacaaaatttctatcacaatttaaaactattacataagaaaaacaaaacaagatattgcaatattatttatcattattaaatttcgttcttaaataatcacataaggtaaaattactagctataaataaatcattatcacatacaaccttacctttactttcttcaataaacaattttccaacagcagcttgatatttattaagattagaataaattaacgcatcataagatgctgaacataaataagaaaaacctaaagtcatggatcccatagcacgtattataacagcttgggaattaagttgtttatcaatcataccaacattaagatgcgtaataacaaaatcaattacagccctacttatactttgtttattacctacatgcatcttgatataacgagattgcacattttctgaaaaagcacctactcctttttctacataaaaagtctcttttagtattggagcatcaattacagcagcaacgggctctccttgacgaaaaaaagcaattagtgtagcaaaataaggtaaataatttataaaattagttctactatctattgggttaacaaaccaaaaattttctccaacatcagatgcatctctagtatcatcaaatataatcccatagtcttgtcggtaattatacagtccatcagtaataattttttttgatctcaaataagcagatctagtaaaattacttgcagtggtataagaagattgcatatacctaatttcactaaaatctctgattaaagccctagatgattgtctcgctgactttaacataatattagtaacagaagaaaaaattacagacatccacaacctcttactttaaatacggttttataatatcaattagttactcaacatataatagacttaataattacccacgcacatttttatttctaacatttccttagacatcaacacacaagagataccacctcagcatatgctgcaacatattcttctataaaacacaaatgctaaatatatttatccctttgctcgctcataatagctatcatctggagtataaacaactattctatccccaggtttaataaaagtaggaacactaatacgttgattattttctaacattgctactttataagcagatgaagaaactgtctgtcctttaatgacagcctcggtttcaaccacttgaagagttacataatctggtactttagcagatattatttctccattgtagaatactaaagtaataataatattatcttgcaagtatatacttttatcacccaatatatctttgctaattgtaagctgctcataagttttaaggtgcatgatagtaatcattgacccatcaccatagatatattgataatcagattcatcaacaatagctcgttttatatctccatctgcacgaaacctttcatattgtttagcaccagtttttaaattcttcatttcagcttgtatataggcaccacctttacctggctgagtatgcataacttttacaactaaatacaaagcattattatgttctaatacatgcccaggcctaatatcactacctctttctgccattccttataaacaaaaaattataactctgaaattctattcctaaagcataagtaattcaagaaaaataaacatccatagcaactttaatcacaagtaaatttcatgattcaccacttttataaaggtcttattttatattaacctaccaatgatcaacacaacataaccactatataaataacaacaaacttaggtaagatttaagaataaatataaccttaactaataagtcactattcttatattgatattaacaattttattacttataatgagcaaattagtggtgtattatttatatatcaacataactcatcagtcataaattttaacgtttaaaaagtaaaattgataattacaaccttcaatattcaaatatacaattttcatatttcagttagtatgttacaatctttacaaaaaatatgttagatttcgaactcactgtacagaatctatatactagagaaggcttagtcaaattagataacctattcttatcatacctacagtctaataatcaagatctatatgaaatattaattaaagaacgccagaataatactaaagctgacaatacaccatatattatagaactttcatatatacttgagcatttcataacacaattatttaagattgaggacgaaataataatacaacgtaataaacataaagagttctcagaaatatataaatgtaaaagactatttatacaacgctatgctcttaaaaaatacccagacatcaacagcttaaatatatcagaaacaatacaacaaatcagtcagctatttcaattacctattcaagagaaaaaatttgctcaacaagtattactatggtttgaagatcaagaaaagtattcagaaaacttagacattacagctaaatatgctgcatacatggtacattcgaaatcaaatagtatcttattcaacataccaaataaaatagatttttcaaacctagtccatacaacaacaacaactatcaataatgatacaactgccatgatgtcagaacacatcaaacgcagagatggctttaatcttacccatacacaacctactttatatcaagctttaaataattgtcactactgcattttttgccacaaacaaaataaagacagttgctcaaaaggattactagaaaacaacaatacatttaaaaaatcaatattatcaacagaattgcatggttgtcctttagaagaaaaaatatcagaaatgaatctagtaaaatctcaagggtacactatagcagcattagcaattgctatgattgataatccactatgtgttttaacaggataccacatttgcaacgactgtactaaatcatgcatttaccaaaaacaagatcctgttaatattccaatggttgaaactcaaattgtaaataatgtacttgctttaagttatggatttgaaatatattcattactcacgcggtggaatcctataaactttgaacgacatctaccccaaattagtacaaacaaaaatgtgcttgttataggattaggaccagcaggaattaatctatcacatcaccttttaaatgatggacatactgttgttgcaatagatggattaaaaattgaacctttaccacaacatatttctggagttactcaatttggtgaaaaaacagaattcaaattaattaaaaatgtagaaacagaattatacgaaaacttaagtgaacgcatacctcatggatttggaggagtatctgaatatggaattactgcaagatgggataaaaattatttaaaaatagcaaggttaatactagaacgaagaaaaaattttgcaatgtatggaggaataagatttggtagcacattgacaatagaaaatgcctttgaaatgggatttcatcatattgccattgcaacaggatctggtagtccaaatatgattaacgtacataattctttagtacgaggggtacgtatggcatcagattttttaatgtcattacaactaaccggcgctgcaagaacaaattcaattgcaaacttacaaattagactaccaattattataataggcggaggattaacagcaatagatacagcaacagaagctcttgcatattatccattacaagtagaaaaattcctcacaagatatgaaacattaatacaaatttatggaaaatcatatatagaaaaaaactggacagaagaagaaaaacttattgcaaatgaatttttaaatcatgcaattcaaatcagagaagaaaaaatattagcaaaaacagaaaatagagaagcaaaaattatagagctactacaactatggggaggagttactattgtttatagaaataagttatcagatgcaccaagctacaaattaaacagcgatgaaataaacaacgcactagcagaaggaatatatttcattgaaaatttacaaccatatgaaataaatattgatcaatacaatcatgtaagtaatatcacattgattgatcaatataataacaaaaaaacgctttttacaaaaactattataatagcagcaggaactaaaccaaacttagttagtataaaagaaaaccaacaatttcgggtactaggtcaagattttactcatacctttgacttacaaggtaacaatatagaaatcactacatccccaaaacctacaaaaaaagatagtatattcatatcacctgataaaaaaattagtatttttggagatctacatctaccatatagaggcagcgtagtcaaagcaatggcaagcgctaaaaatgggtatccaatcataacccaagcattaaaacaatgcttaccaataaaagataacctatcactaacaaaattaaatcataaattaatagcacatatagtagacataaaacacattacaaaaactatcaccaaacttaccatatcagcccctcttgcagcagctaacttcaaacctggacagttttacagattacaaaactttgagtgtaatagtttgaacatagaaaatacacaattcgcaatagaaagcttagcattaacaggagtttctgtagataaaaataaaggattaatctcaactatagtacttaacacaggaggatctagtcatctatgtaattaccttaaaaaaaacgaacctattatttttatgggccctactggagctccaacagaaattccccataatcaaaacataattttaataggtggaggagtaggaaatgctgtcctattctcaataggtaaagcattattatcaaataattgtaaagttctatatttcgcaggatataaaaaattagaagatgtatttgaaccatcatccatagaagagtcatcaagtactgtagtatggtgttgcgatgaaaaaaggattgaaccaaaaagaacccaagacaaatcttatcgtggtaatataattgatgccataattcaatataacaatcacctatcacaagacgttgacatacctctatattctatagatagaattcttatcattggttcaagccatatgatggatgcagtatcacatgctatatttaatcaattgcgcactttttttaaaaaagagatcaaagttatagcttctattaattctcccatgcaatgcatgatgaaagaaatatgcgctcaatgcctacaaaaacacattgatcctataacaaagcaagaaaattttgtatatagttgcaataatcaagatcagtatgcaaattatgtagatttcaatttcttaaacgaaagacttaaacaaaatagcttacaagaaaaatgtactaaacactggatagattactgcacacataagttaccctcaaaaacataattcgtacaaatacaagttaagtatcaatacccttaagtttacacaataacttaagtcctacaaattccacaccttactaaacttaatcagatgtactaaaaaactgagatattatttgaacattaaaagtaggcacataatattttccctataaacttacataacattcgatttttaattacattaatcctataaactacaaactttttatttcatattgcaaaaactactaagtaatgaccataagaaatcctatattttcataaacattaaacataaaaatgccagtaacctaatttagcaaattcaatcataaaaattggaacttacatctttagctgaaaataacacataccaacaaaattatgtaaaaattcaaaattgcaacaatatttcccaaattatataaatttatcaaatattaattgcataaaatactgcaaagtttataatccttcaaaaagtctggggttgagtaatgctttataattttattcataatatccataaagagggatatatatttataatgatatcatttcttgcgtcttgcattggatttgctatttcttgtagcttaggaataatttgtttagtcatatcattgctatgtatatattttttccgtgatcctatacgtatggtgccagaaggagatgatctcattactagtccagctgatgggttaatattagatattaaagaagtgaactctcctatagatgattctacacaagtagtatgcattagtatttttctaaatgtgttgaacgttcatgtcaatagaattcctgtttctggaactattaaggctacagagtacataccagggaggttcatatcagcttcactaaataaatcaagcgaattaaacgagagacaaagattaattattgaatccaaaattgacaaccgttcaattattgtagatcaaatcgcaggattaatagcacgacgcatagtatgcaacgtttctgaaggtcaacaagttaattctggagaaagatttggtattattaggtttggtagtcgagttaatttatatctaccattaaatactcacatatcagtgtttaagggacaaacagtaataggtggagaaactattttagcatatttacaagacgctcctaaacaattaacagttaagtctatataataatatgaaagaggagcagagtagcaaattttttcctattactaggttatttcctaatatagtaaccctattaggtttatgtgctggcctgacttctataaaatttacttttattggtaaatgggaatctgctgtaatgttcatcattatagcagcactcatagatggaatggatggtagaattgctagatttctcaattctacaagcggcttcggtgctcagcttgattcttttgcagattttttaaattttggagttgctccagcatttttattgtatttttggtctcttaagcaaataaaagtcataggatggatgctagtaatgatgttcgtcatttgcatgtcaatcagacttgcaagattcaatgtgtccttatatgaagaaaaaaaattagattggcacaaatttttcttcgtaggagtacctgctccattaggagcagtactgtcattaattccaataatgttgaccttttactaccatgataatcattggttagttacaaatttatctgatcaaaataatgtagcaatatactttgccgttattgcatttttattagttagcaacattcctacattttctgcaaaacatatttatataccaaaaaatctatcttatatatttattctactgtttggcatattcattgtatttgcaataacaaaaccatggattacatttccagttgttggaatgatgtatatattatcaattcctataagtagcatggtatacatatacattatgtgcaaaactaaaggtaaaataatctagtacacaattaacaatgacaatccttgaatttgcagatttttttccacacatttctggagtattagagtctattttttctctcacaatattcagaattccactaattattttatgggtaatatgtttaggaacattctgcacactaaaatttaaatttatcaatataagactttttaaacacgctttatatgttctaattaagccatataacaaaaaaaacagtaatactatttctaatatccaagcatttactacagcaatatctggaactataggattaggaacaatttcaggagtaattatagcaatttctacaggaggtccaggagcagtattgtggatgataataataggtattttaggtatgtcagtaaaatttgctgaagtaacattaggattcaaatattacttgttagaaaagaaaaaaaatataggaggaccttttcaatatatcaaatgtggattagctgaattaggattagttaaaacaggaaaaatcatcgcatacatatatgctgtcataatgataatagctatgtcttttggaggaatatcatttcaatcaaatcaagctactgtattattaagcaacaccttccacaaaataaacagcagtactattgttataacactaacactattaagtggattagtaataatgggaggaataacacgtattgcaaatattatgacaaaattatctcccataatggttatattatatatagtcgtatgtacagctgttattattagtcattcagatcaactactttctacgctaagcacaatgctacacggtataatagaaggaaatagtgttactggaggagcaataggatcttttgttgcaggggttagaagatcagttttcgcaaatgaagctggaattggtacttctcctatcatacatgcctcaacaaatgatactgaacctgcaagagtaggatgcattgcaatgcttgaaccatttattgacactgtacttgtatcatttatcacgggaatagttgttatactaactggatcctatagcactataaacagtagtaatcatgtaataataattaacaatatattttccaacatttgtccaatttgtgaatatattatactcccttttatcatattctccttcgcattttcatcaattatcacatactcttattactgtgaaatatcttggaaacatatatttggaaattcatgtcatgttgtattatgtcggacattaataatgtgtatcattctaattagtggattatccaaaaacatagttcctatatctcaattaggagacctgctctttatatttctcacaatacctaatggactgacaattatcttattaagtggtactataaatcaagaacttaagaaatatttatgcaaaaactaattgtattacgaacatctattataacaaccattaaaataacaaattgagtttctcacacaataaagttcatatttcatatcaaaaaaactagcaattctagcttttatatatgttactaaaaaaccatcacaatcaatacacaattttcaaaacacagattaagtataattattaatatattgattatctactatttttatgcaagtcatcatctaaaataaatatatctttgaactatcttgacatatcaactactaataaaatttacatggtatgtatttatacccatattagttaatttgataatttatattgccttattgatttaaaaaaagctatatgctacactaaatttcattaatgtgctcattaagcaatatggtagaagttcgtaatttaatattggctgttattttatctgtattgatcatgatggggtggaggtttatatatgataaatttttcactacacaacatgctatagaagataatacaagttctgacgctatgattccagaaattgatgataattttatacacaagacacgatctgaagtgatagaaagcaataccaacataaggatcaaattatccaatgaaaaaatgaatggatcaatatcattaaaaggagcacagtttgatgatttaatattcaaaaactatcatgtcacaccagataaaaattctgaaggaatagtattattatctccagaggaaacagagaatgtatattttattgagtttgggtggatagatccccaacataaaatcactgtacctactcattcttcaatttggaattcagatcaatcaactttatctccaaataatcctataactttaacgtgggataataaacaaggtgttgtattcaaaataaaaatcaccttagacaatgactacatgttcaaaatagaacaaatggtcacaaataatactgattctataataaatttaattccctatggaagaataaatagatctaaacatactgcagaaaaatcttattggatatcacatgaaggagctgtagggagttttgggaacacactaaaagaatggacatataaagccatcactaaagagaaaaacataaaaatccagcaacaagatataaatgacaatcaaaatcaatggattggtatcggtgacaagtattggttcacagcattaataccaaacgtttcacaaaaaagtaatctaaatttccatgtaaaacatgctaaacataatagtaaagatcgtttccaagtagattttagccatgataactatattgcacaccctaataacacagtaactagcataaattatttatttgctggagctaaagaattaaagctattagatacatataaagataatttaaatatttctttattcgataaagctgtagattttggagttttatattttattactaaacctgtattccttttattagaatatttcaataatgttatagggaactttgggttagcaatactattactaacaatagtaataaaattaataatgtttcccttgtcacataaatcatatgtctcaatgctaaaactaaggcatttacaaccagatattgtaagaataaaagagttatacaaaaacgataacgataaaatgagtaaagaaatatcagctatttttaaaaagaataatgtcaatcctatgtctggatttgtcccagtattaatacaaatacctgtattctttgcgttatacaaagtgttatttgtcacaattgaaatgagacatgcaccattttatttatggataaaagatttatcaagttttgatactgcaaacatattaacaatatttggattattaaagtttaatccacctatctgcattggtatcttaccagttatattaggtattactatgataattcaacaaaagttaaacaatcatagcagtttaaatcaagacaaaactcaagcaaactttatgaaatttttaccttatattttcatatttatcttttcatcatttcctgcaggattaattatctactggatatgtagcaattcgattacaatagtgcaacaattaataataaagcattatgtaactaaaaaattcaatttttacaaaaccgtgcaacaggaggattaattatgtcaaatgatcatatcaatatactaatagtagtatcacaattttattctgatgtagcagatcttttattaaatggtgcagtagatcaattaaaaaaatattctaaacctgtaaaatatgatatagtatacgttccaggatcttttgaaatacccgcggctatagtgtttgcaataatgagtgacagacatcactatgatggatacattgctttaggttgtgttattaaaggacaaacagatcattattattatgtatgtaagggggtaacaacagctctaagtgaaattgcaactcaccatgctgttcctatgggttttggagtaattacagctggaagtttagaaatagcaatggcaagagcagatatcaataaaagaaatgttggtggaaatgctgccaaagcagctttaacgatgattgaattacataacaaatttttaagttaaaattatgaaagataatatatgccacacacatttgtggcattcaaaaaaaacaacaactaggttcctcgctatacaaggaacctattctatgatatttaataactatactataaatgacatcgataacttaattgattatctatatgaaatgaaggaagtattagatttaatacagattgacaatcagctactacttaaaattatgaacacaatgctgttaaccttcaatacaatcaattcaacaattgcaacatttttaaatgagaaatggtcaatagaccgcataaacttaattagcctttctattattaaaaccgcagtttgtgaattaatatgttccgatacagatgcagtaatcattataaacgaatacgttaatatagcgagtcatatattagaaagaacagacgttaattttattaatgcaatattaaatcaagtaaaatttacagcacgtcctgtcctaaataaaggtataaattttcatatcgaacaaactgaatcctctgctatttttaatagtacataaattcatgagaacaactagaaagaacatagtttataacctcatatctacataataatgaataaaaactatttccacaattatcagatcatatttcccctagtattgagtgtaatcacaatacaataaaaacacacacttaagattacaaacatatattattattgaattaccaaaattaactggaaaattgttaatcttcatatatcattaatagtcctactctgttactcactaattaatgtggtaaactaaatatgactgatttgattagtatacgtaatgctaaagaacataatcttcacaacataaatatagatcttccaaaaaataagttaattgtaataactggagttagtggatctggaaaatccagtctcgcatttgatacaatatatgcagaagggcagcgcagatatgtagaaagtctatcatcctatgctcgtcagtttttagattcatgtacaagaccagaagtagaatcaatcacaggtctttctccaactattgcaatcagtcaaaagcttttatcgaaaaattcaagatctactgtatcaactactacaggaatttatgattatttaagaatcatgtattccaagataggaacaccatattccccaataactggattacctataacaaaacaatcactttctcaaatagtagaaactatcttgaaattaccaataggaacaaaaatttcaattttaggtatactaataagagggaaacgaggagaacataataaagaaatatatgaaatcaaaaaacagcactacaaactattaaaaattgatggtattacttatgatattaacaatattccacaactagatagaaataaaaagcatgatattcatgtaatcataaatcagatatcagttctagaaaattctattgacaatataactgaaaacataaaaactgcgttaaaaataggtaatggtataactcacatagaaatacttgatttaccacaagaatacaaaagtgacacgtattacaagaatcaggtactggttttttcagaaaattttgcatgtcctgaaacagaatttagcatagaagaagtagaaccaagattattttcattcaatacatcatatggatcatgcaaaatttgtagtggaataggaaaaaaatatagcgttgacaaaaatctagtcataaaaaatgataatttatcaatttcagaaggagctatacatcctataggcccaattgatataaaaaccattaattacaaaattaattcgcaatttagctatcattactcaaatattattttgtccttagcaaaacattatagttttgatttaacaacaccatggaaaaaattagatgataatataaaagatataattttatttggcagcaaagaagtacaaatacctacacattatcaacacgaaggatataaatattctagaaacaaaccatttgaaggcattataaatatcttaaataacaaagaagacatagttatcgaaaaattagctgaacaatattcatctataaacatatgtaatgaatgccaaggatttcgactaaggcaggaagcactatcagtaaaaattgacaataaacatatcggagaattgacaaggttatccgttatagacgcaatatcatggtgtaaagcactaccgtctagactcaatgatcaacagaagcatatttcacataaaatattagacgaaatcattaaaagactaatatttttaaaaaatgttggattaggttatttaacactcgatcgtgaatcaggaacattatctggaggagaaagtcaaagaataaaactagcatcacaaattggatccggattaacaggaataatttacgtattagatgaaccttcaatcgggttacatcaacgtgacaacacgttattaattaatacattaaaaacattacgcgatataggaaacacagtcatagttgtagaacatgatgaagaaactatcacaaatgcagattatgtagtagatataggtccaggagcaggacaaaatggaggttatgtaattgcaagtggtactccaaaagaaataatggataatcataacagtataactggccaatatctcagtaacaaaaaaataatacctaacttcaaaaagcatagaactttttacaaatggatagaaatcattggagcacatgtaaacaatttacaaaacattgatgttaaaattcctttacatgcctttacttgcattactggagtatctggaagtggaaaatctagcttaataaacaatactctatatcaacatgcaactgatcaactaaataatattaactgtatatacagtaaatgcacatctatatcaggattagaacatatagataaagtaattaaaatagaccagtcccctattggtagaacccctttatcaaattcagcaacatacacaggattatttacccatataaggtcatggtttgctgaattacctttatcaaaagaaagaggatatactataagcaggttttcatttaactctaaaggaggaagatgtgaagcatgtaaaggggatgggcaagtaaaaatagaaatgcattttttacctgatgtatatgtcaagtgtgaacaatgcaaaggatcgcgttataacaaagagactctggaagtaacacatcaaggaaaatctatagctgacatattagatatgacagttgatcaagcatacgaattttttatccatttaccattaatcaaagaaaaattagatgccttacgcagcgtaggcatgggctatattaaaataggacaaacatcgaatacattatcaggaggtgaagcacaaagaataaaattatcaaaagaactatcaaaacgttcaacaggaaaaacattgtatatattagatgaaccaactacaggattacattttgcagacatagataatttattacatgttctacataaattacgtgatttaggtaatacaatagtagtaatagaacataatttacatgtcatcaaaacagcagaatacataatagatataggtcctaacggaggagatgatggaggtcaagtagtagctactgggactcctgaagaaatagttcaaaaccctcatagcataactggacaatacttaaagccttatttaaatgcccaatcataaagctatacataaaaaagcatattataaattaatatacttttacttagcatacgcatacacacacatcatttaccaagaagagtagatgtaagctaatattcagcacagtagagctgaacaacacataaaaactttgtaaacatcaataaactagcttacacctacataccaaacagctacagtaacccaattacatgctgtttacttaagtaaaaaagtatactttacaatatcaaaagtttttaaaactataaccacaaattacacaaatatctctaatatattaacaaatacaatattctacactttgtatattgtttacttaagagaaatataactacacttaatacaccataatctaaatatacaggcccttatcattaccaagtaaccttatacttacaacttcatatatagtacctactaaaatacatataagtcaaaactatgccaaattattatagaattcttgaatataattaaaaataatgcttcacgcttaataatatgccatgcttagaagtctaatatcacataatattattttattaaagcattctaacaaaaattatccacttttcattcattggaacaccttagtaataataggacgttcctaacaagatgtattttacatgtatagaattctaacaagtcatgtaaaaatttataatgtaaatttattcagattattaatagatataaaaatttcttctacagagtacttctttaatctttttctagattaaaaattaatcaaatctcattaacatgtttattattacactacagatttatcaatgtacactattataaaaaacagttatataatatcaattattccaatgccgcatataaaacatacaataaaatagccattttactcttttcataccaattatatattatacttcactttcaattaatgatatgattaatgataaagggtgtgtaatatatgttaataaattgacataaaattaaaactctgtaagtatttaactattcactaaagtacatatatgatacaaatgtttaatattgccgaatatgttcctgttctaatttttttagcagtttcaggctttatttcatttcttttttgcatcttaccaatgcttttagctaaccgtagcccagatttagagaaactttccccatatgaatgtggatttgcccctcttggaaattcaagaaaaatttttgacatccgattttatttagtcgcaatattattcattatattcgaccttgaaatagcattcttatttccatggtctatttgtctttcagacataggcataaatggtttttggtctatgatggtttttttggctatattaacagtaggttttatatatgagtggagcaaaggtgcactagaatgggagtaaactagtatgataaacaagaatgattctgtattaaataatcaattctggcaaagttacaaccatcaaggtttcatggtaactcagttttctgacttaatcaactacatatcaaattgggcaagatcaaattctttatggcctatgacatttggattagcttgttgtgctgtagaaatgatgcacactgcagcaagcagatatgacctagacagatatggtgttatgtttcgtgcaagccccagacaagcagatgttatgatcgttgctggaacactcaccaacaaaatggcacctgcactacgtaaagtatacgaccaaatgacagagccacgttacgtcatttcaatgggaagctgtgcgaatggtggcggatattatcattattcatattcagtagttagaggatgtgaccgcatagtaccagtagatatttatgttccagggtgcccaccaacagcagaagcattattatacggaatattttgtcttcaacaaaaaatcaatagagggaatacttctattacaagaaaatctacacaagactagcatataatacaatactaaaatttattgttaacataatgccattatagctgtcatatgtaagcaccagtcaaattttgatcaaaaataatatttacacaatactactttgacttgcgttattaagtaagaaaaatactatatcgaaataggtattagactcaataatgcacaagctatgaagaaatcctcaatttcacaattatgtaataataaaatttactcttcaacattaagttataccattatccttatcttcaagcctaatatacttactgtatagtgccataaaaaggttctttaaaaaaataaaaaatacctaagttatataaacaagatatactagtattcaacatacataatattaatgttaataccttaattcagaaaaataatgtatagtaaagaaaaaataaaagaggatacagatgtcagatagtaataatgcaatagataatattagtacatatatcaatacatctataaatgtagaatgtgtcataaaagacaatataacgttggaactacattcagatgtacaaaacatctataatcatatttcatttttacgtactgatacaaagtgtaaatttcatattttagttgatatttttgcaatagattatccaacaagattggctagatttgaagtaatctattcattattaagtataatcaacaatataagagtatcttgtaaagtacctttacaagagaatgagagcattccatctattactaacattttcagtgctgcaggatggtttgaaagagaagtatttgatatgtatggaataatatttgccaataatccagatctacgcagaattctaacagattatggattttctggccacccaatgctaaaagattttcctttaactggctataaagaagtacggtatgacatatcaaaaaaagaagtagcttatgaaaacgtaaatttacagcaagatttcagatcgtttgatttcctgtctccatggaaggaattaaagaatgaatgaaacaactattattatataactaaatatcacacattttttatacatgaaacaacaattaaacttaacatcataaattcactaaacaaacttttatgttgttcttctaaattacttatttctacacagaaaaatatacttatattattccatcaagtttattaacattatcatgaataacaaatttcaataaatttttgatattacacaaacacaacatttaactttagaaactttgacaatttattttgttttatacttactaggtttataattttcatcatgcttagctaaaatttcatctgcaataaattcactgcttaccatttttccttttgctactatccaactaccttctgagaataaaggaggtaatattcctttatataatattttcatatgattttccaaatctgttatataaaaagaaataaaatcatcatgtttttctacgctaccttttattatcataccccctattctaatatcacgattattattatatatagcatttgatagaacctcagtcggagtaaaaaaaaatgatatattattttgtaacttatttaagacaacaacaactgacatcccaaatatagcaaatgttacaacagtaaaaagcaatcttttatgttttcttttcatctcttcgatcaatactctctagaattctcttacttttactataactaaaaatgataaaacagcttaacccaaccaataaaccaaaacttacagtatacgcaaaaattacaaacatcatatattacagccttcgttaagtaacattaaagattctagaatatcgaaatccgtcatatcaaattttaatggtgtaattgtaacatatccatcatctaatgccctaatactatcatcagattcacctctactatccttatcaggagcagttctatgtatcgtataagatatactactagcagcatttttcttcttttctattttattatatggcatgtattttccttgacttgtaaatttaataccttttgctgatatcaaaggaaagttaacactcattacagtagatttatcccaagatggagcacctaatagcatatctacaataccctttaagaacttccgtggattttcccaatttatttcaccacttctaccatcatattcctgactgatcgcaattgatggaatactcatcatagctgcttccgccgctgctgctatagtaccagaatatgtcacatcattacctatattaactccactatttataccagataaaactaaatccggtttctcaccaacaatttcttttaatcccagaaacatagtagtagatggagtactgtttacaataaattcagtatcactgactttatacacctctattgcatgtcttaaacctacagatctcccacaaccactacaattacttaatggagcaactacccatatttctgatgcaatacctgctgccatcactatctcttttaaaactttaataccatttgcatgaaatccatcatcattagtcaataatactttcatagcacttttattccctaataattaaacaagtataacataatatagtttttaagcccataacaacaactattattatacttctaacatatataatagatgtattctctattcattaacaataagtactaataatacaagattaacgacctaataatagaacattaataacattatatagctaaaatgctatttcatatgtactatctaaaaatcaatattatttacattaatatatttccaaaaaatcatctccacatatttaaacaataacattttatcctaaaaaattatgatatctaccttttaactgttcataacttaacaaaaacatatgacctttgatacaaaacattatcaatttcgcaactcatatacattttgatattgataataaaatatcttcaactgtttgcacaggatcactactcatggtaattggacgtccaattactaaataatttgcaccagctaacattgcatctttagggctctttacccttttttgatcattacagtcactatcaaatcttatacctggcactataagctttaaatccttttctgtatatcgattacgcacttcctttgcttcaaaagcagagcatactataccatataacccaacttctctagctaacttagacaaaagcataacttgctgaacaggtgattcattaacaccaatttcctttaaatcagaatcatccatactcgttaatacagttacacctaccaactttgttacactaccagatatgctatccatagctctgatcatcatctccctaccaccactaacatgaatagtaagcatagcaacatttaaagatgctatcactgatatagctttacttaccgtattaggaatatcatgtaattttaaatcaagaaatataggaacaccacaatcagctatcgcttgtacaccagataacccatacgctgtaaaaaactctagtcccaactttaccatcgatactcttccataaagcatcttagtcaacagtaatgcatggttgatatcatgagtatccaatgcacaaataatcggattagtaaacataaatattcctaaaaaacattcaaattatactaatattaactatttaacacaactttattaatttgaataaatattatatattacctcatcgtcatattattctgtgtgtaatactaatactttcattactaataaaactaatcattttttatagttcaccagaatatatatattctacatttaaacaaatactgagctttcctaaagtcactatataacaacgttactattaacaacagttcatactatttgaatatatagaataatatattataaatgaaaatgttcagaacattttttaaacagtttaaaaaaattctttgtagttaaattactaacttcctcaaggctttcattccataagttagctaaatattctacaacaaacttcgtcttagctggctcattcctttgcccacgataaggttcaggagataagaatggagaatccgtttccactaacacacgatctttaggtataaaccctgctacttcctgaacaacttttgcacttttaaaagtcactattcccgaaaaagatatatataaccctaattctatcgctttgattgctaattcccttgaagatgcaaaacaatgcataagtcctaaaaatggactttctttcatttctgattccaaaatttccatcattcttttgtccgcatttcttgagtgaattataacaggcaatcctgtttccctagatgcattaatatgagataaaaaattcttctcttgctcccctacttgactacatttataaaaatctaaaccagtttcacctaatccaataactttactatgttgagctaaatctactaactcatctactgaaacagactccccatttgcactattagtaggatgcacacctactgaaaggtaaacttgcttataactttctgcaacttttactaaatcagaaaattcagctatagtagtacatacagtttgcattaattttacattattctcctctgcacgcaaaactacatcttttatttcacttggatcaaaataatttaaatggcaatgtgaatctacaatcatatacttacactaatcatattttttttactaaaattaaaaacaatctaacaaacatgcctgtggtcattaacacaaattcaactataaatacatcaaaacttacatttatcaaaaacataaaactttctaaattataccgtaataacaaaagtcctgtagatcaaggaaactttttatacgcactaacaaatactatactaaacaaacccaccaaaaagattagttactactcataatcttgaaatgaaaaagctatctacaaaaacttatacatcagattatcaaatttttagctcggtttgacagcaacgatatttattactcgttttggaataacatatatatcttttacaacattgccacctattctattcttagctatttccaaagccatagatttaagttgatcatcatcaatatcattagcaactgttaatgctttcacaaatttaccattaacctgcaccacaattgtaacatttctttcaacaagtagctctgaatctgctttaggccatacctgattccataacatacctttaccccctatattttcccataatttttcagctatatgtggaataaaaggttctattactctaattagaatatatattgcttcactcactacataacaatttactgaagttcttatcatttcactaatgatattgcttaattccctaaacttagctacagcacaatttaaacggcaaaaatctaaatcatttgtaatgccacttaaaattttatgcacagatcttctatatttaacatcatctcctattatattttctttgttaaaatttaaattaaacttatcataagaaattattaccctccataatttactaagatacctacttgccccctctataccatcatctagccattctatatcacgctcaggaggagtatctgacaatataaataatcttgctgtatctgctccgtacttatcaataatatattcaagattcaccacattttttttcgacttactcatcttctcagctctaccaacagtaacatgctgaccattttccatcattttttttgcttcttcaggaaataagtaattaccctgctcatccgaataagtagaatgacaaaccataccttgcgttatcaaattagaaaaaggttccttaatattaaaatatccacacttagttaatgctcgacagaagaatctagaatacaacaaatgcaatactgcatgttctaccccacctacataataattgactggtaataacatgttacacacatccttatttattccattgctagttccacaaaatgctgcaaaataccaagaagattcaaaaaaagtgtcaaaagtatcagtctcacgttcagcatccataccacaagatggacattttacatatttccaagtaggatgattgtctaaaggattaccatattttgtaaaatcaacatctttaggtaaagttactggtaaatcttttttatctacaggaaccgtaccacattttttacaatatattatcggtataggacacccccaataacgttgtctagatatcccccaatcatgcattctataatatgttatttctttgcacacccctaaaaatgtaagctttgcaactatagcttttttagcttcatctacagtcataccatctaaaaaatcagagtgtttcataatacctgagccaacataagcttctttatctaagttcacatcaacttcaggaaataccacttgctttactggcaaggaatatttctttgcaaattcaaaatcacgctgatcatgtgctggacaaccaaaaattgcccccgttgcataatccattaagacaaaatttacaatataaactggtaaatttacatttaacaaaggatgttttacaactaatccagaatctattccaaatttttctattgtactagatacatcactgattaaattttttctgtcaaaatcatttatcaattgaattacttttgaatcattaacatattgtaaaatcggatgatcaaaagatactgcaataaatgctgctccaaacaatgtatggggacatgtagtaaaaacttgtaacgttttattaatacctaaaatttcaaaatctattactacaccctgagacttaccaatccatttttcttgcatcaactttactttctctggccactgatctaagatttgtaagtcattcaataactcttctgcaaaatcagtaatctttagaaaccattgaaataattttcttttttctaccacagctccagaacgccatccccttccatctataacttgttcattagcaagcacagtttgatccacaggatcccaatttaccaatgactctttgcgataagctaaaccacactttagaaaatcaagaaaaaatgcttgttcatgtttataataacttggatcacaagtagctaattccttatcccaatcataggataatcctatagatttcaactgacatctcatattatcaatattgctttcagtccaagtatgtggatttatattataagataaagcagcattttctgctggtaatccaaaagcatcccatcctatcggatgaaagacattaataccacaagcacgtttatatctcgcaataacatcacctatagtataattcctcaagtgacccatatgtatgttaccagaaggataaggaaacatctctaaaacgtagcactgagcttgttttgcatcagtataaaaattccattttccttgtatatcttgttctacttttttgaaatcataatgcatggtacaccgttgataaaaattccattaaaaactatttcagcttagttgttgtacagtacattatcagataattcaagcaatacaaaatatacacataccataaagatccagaatcatttctttactttagcatgaatattattaaaatataagttttatatatttataaattaatcaatagataaaaatttgcaaattatatacttcattatcaataaattataaagtgatttaatataatatatctaacatataagttgatttataaagctaaatattaaaatgcgagatgaaggtgtataacaaaaaaactatttctttttattgcaagaatcataaaaatattaactatatgtgtatataattgaataatataaataaaatcatataacaaatatttcatattaataaattataaaacgatataatataatatttttaatatataaattaatttataaagattattcttgtcttactagattacggtacataactatgacaacaataagtaaccaaaatgattacggcactaagtataaaatactcaagttaataaaagatataacatataagaatcactggaaccaagtaaccacagcaaggatactgggcgtagaccaaccaaaaatatctcagattagtaatggtaaaacagcaggattttcattagaacgtttacttatatttttgttacgtctaaaatgtgatgtgaatataacaatcactgtcaataacccagaaattgcattaattaacaaagacaatatggcagagagttccctagaatctattaatcttgtaataatacaaaaagaagattaattagagatttttagattgctctattgcataattttctacatatgctagaataaagctttcattcatatttggtttgttaatggcacgtcttacagttgaagaatgtatgggtcgtactaataataagtttaagctagtgatattagcaagtcagagagcccatgatctaaattctggagcatgtccagtaataaaatacaaaaatggtaaaaatactgttattgcattaaaagaaatagcagcaaaacaattagacgtatcctctttatttaatttgtcagtacaaagatgtcgaaaatatatggagaaatttatcaattcagatgaaccatatattgctcataaaccaaaaaacaatgtcgatatctttcaagcgagtgcagtagctggtaactctgatggattggaaaatagctcaaatagtcgggatgataacccattaggtagggataattttttttctaccccagaaaacagaaacaatacaaattcttagtagaacactactacttgtattactagtatatatacttgttacattttgtttatgaacttttagctttatataggcgcaaaaactggttatctatatgtttaaaaaattagataaaagtacatcagattgctctctacatgatgatacatcactatgggcctccattaccctaacggccactccaatttatactaataaggtcccatatacaaaaatcagaaaaattaataataatcttaatacttcactaaataacaagtatactaatcattatacaccaccaatatacacaaaaccaaatagtacacatgatattagcagtggttcaaatctcaataacaatactaagaagaaaatcgatcaaggaaaataccatatagactccatccttgatctgcacgggtacaccttagatgctgcttataacacattaatgaatttcataattaaaaattataactcagcaaacaaactcttactaatcattacaggatggggaagtactgataagtataatagtaacagtataaaaagtaattttagcaagtggctacaaagcgtacaaatagcaaatttaatattatactatagagaagctaatcgcatacatggaggaaaaggagcattttatgtactattaaagagcaaaaataaaaagatttaatatataaatactagtaacatatacaactaattagattgatttaaagtttaaatttttacaaatatagacattatattaaaacaaaatatactatgtatttatatagtatcttctggtcaatatgaaaatagactttaataccctctttccttcttcaactaaagaatacatatcaggcacaatatacaacaatataaaagttggaatgcgtagaattcatattaatgataacagtgaatccattctaacatatgatactggaggaccacatactgatcaaaaaatcaaaattgacattaatcagggtattgaaaagataaggcttaattggattgtagatagacaagacgtagagtatcataaaagacaagaagtaaacacaaattctgaatacgcatttccactacaaagtaataatatcttaaaagcaaatagtaataaacctataacccagatgtattatgctcgaaacaatattattactccagaaatggaatatgtagcaatacgagaaaacgcactaagacaaaagattctttcttataaaccaactgtcatggcaccagaaattactccagaattcgtacgacaagaaatagcatctgggagagcaatcattccagcaaatgtaaatcatcctgaatcagaaccaatgataataggcaagaatttcttagtaaaaatcaatgctaatattggtaattcagtagttagttcaagcattgaagacgaacttcaaaaaatgatatacgcaattatatacggtgctgatacagttatggatttatctacagggaacaatatacataatattagagaatggattatcagaaacagcccagtaccaataggtacagtacctatatatcaagcattaaacaaagtaaatggagtagtaggagacctagatttcaatatcttcaaaaaaacattaatagaacaagcagaacaaggtgttgactattttaccatacatgcaggagtattaaaaaattacattgactacacagataacaggctaactggcatcgtatcaagaggtggagctattatggcacactggtgtactatacataataaagagaactttctttatacaaattttgaagaaatatgcgatattatgaaacactatgacattactttctctctaggagatggattaaggccaggatccatagcagatgcaaacgatacagcacaatttttagaactcaaaacactaggagaacttacagacattgcatggaagcacgattgccaagttatgatagaaggaccaggccatgttcctatgcatttaataaaagaaaatgtagaaaaacaggttcacttctgtaaggaagctccattctatactttaggaccattaactacagacattgctccaggttacgaccacataacgagtgcaatcggcgcagcaattataggatggtatggcacttctatgttgtgttatgttacaccgaaagaacacttaggattacctaacattcaagacgtaaaagatggagtcattgcatataaaatagcagcacatgcagcagacttagcaaaaggtaatccatctgcttatatacgtgattatgcattaagttatgcaaggttcaatttcaaatggtatgatcaatttaacttatctcttgatccagaaacggcaaaatcactacacgatgaatctcttccttctgagaatgcaaagtctgctcacttctgttcaatgtgtgggccaaaattctgctcaatgaaattaactcatcaaataaaatctattgaagagtaacaaaccgcaactatgttataaagcttgttaagacatattttccagattctgtggataatggggttattaataagaatagtttaaggcagcatttttttgcttatagtaatttatgggttgaatttcagtcgatattacattcgataactttagaaaaacagaaaaattttatcatgcttcataatagataatcaactaagtatgtagtacttgatgtgcatcaacattataattaaattaatttatccattccttataaatattctacattacttactcttataacaaacatctaacctaattaacacaataactatctagagtttcattatctttcaatatatctttattacgttacctatcgattttctatgctcgttatattttacaaattcctgatctacataaaactcatcagcatataaattattattagaagtataatttacaacatctgttaccatatattaaccatgattgtatatgagtattatgtattagtatattttttgctaatttgtgtcctataatttgacccatatttaaaaattttgattaggcatcttttatgtattttatattttgttcatgcaaaaaacatgcactaattgaacatcatcagcaacttagatatttacttctatgactaatatcaaacattatcttttgaatttgaaataacacatcacctttacttaacccagttctaatagtaaaatttgcaaatttttttctgtcattttcagacagctgtatagctataatcgactcaaactctcttatagataaaccacgatataataccctttgcatctgcaataatctattagttgtaacatggataataaaattacaacaactataaaaattagattctatcaatagaggcacatcaagtactacatacttagttgattgtctattatgaaacataataaaatttttctgtttttctaaaattatcgaatgtaatgttgactgaaattcaacccataaattactataagcaaaaaaatgctgtcttaaactattcttattaacaaccccgtgatccacagaatctggaaaatatgtcttaacaagctttataacactgttgtcacaattatataactgacatacaacttgatcagcatcaaatactactgccttaaacaatgttttaaaatagctagcaactaaacttttaccagaacctataccaccagttaatccaaaaatcaccatagttataaataacccctaccaatacaaacacaatctattctcatttctataataaaaaaacttgttaaccaaaaagatcactttataattttaatcatagctctatcattaaaattatatttgtactatttatatatactgacaattaacttatatataaaatgatctcagaagcagtacaagcattaaaaaataaacacttaatattatttcccactgaaactgtttacgcactagctggaagtgcatacagcattgaagcagtacaaaaaatatatcagataaaaggtagatcatacaataaacccttatctttactacttagcaatattgataaaattaaacaattttccactttaacagaacacacttttaaaataatacaaaaactttctcctggacctgtaacttttgtattaccaattcataattataacaaactacctagacaattctttaatgacactattggaatcagaataccagatcaccctatagctctagaaatattaagtaatttcgataatcctgttgtaggaacaagcgttaacatttctggacaacctagtgtcactgcctcacatcaagttcaagaaacaattaagcagcacatttcagtaataatagaagatgacagcttagtaaatggtattgaatcaacagtaatcgacttaacatcatataaaatattaagaacaggagcagtatcagaaaagaaaatccaggatataatacatagtatatagattaacgcataaactttatagtaaaacataaaagttcataaaaaaatattcataccatactgatcaatatatattaaaaaacttatataaataaccttattcaaattaattccttatcaataatcatagcaatttttgctctgatttttaatcaaaccattattattcaacaaaataaaatcagtgtttacaaaaaaaaatatctacgccatactgatcaacataatactagttgtacttaaattaaagatacctaatcaaaatttttaaatatggatcaaattatagggcacacattagcaaaaaatacactaatacataatactcatatacaatcatggttaatatatggtaacagaggtattgggaaagcaacacttgcatatcgttttgctaaatacctaacacaatcaacatatttaaatcattataaccctgatcttttaacaattaatgacaatgaagaaataataggaatagacaaaattagaaatataaaaaactttctctatttaagtacagcaagactcaaatatagaatagtaatagtagatagcattgatagcctaaccattaatgccactaatgcaatgcttaagattctcgaagaaacacctaataactctattatcatattaattagccacaatttgcatgaagttccaacagttgtaagatcaagatgttttacattaggattatcagaccttaatccacaagaaacacaacaagtaattcaaaataactttccccatttagatcataaaaaaataagtcatatctatccaggcaccccaggaatggtaggtcaacacattgatcaagaaattgaactatataaagctcttatttcaatacttaccaatcaatacaataatataactatagaaaacatcataacaactgagatcagcttttataaagtagaacatatactatttactattatgttggatctagcaaaagaaatattaggtataacaactaatttaagtatctacaaacacctaatagacaatataaagaataaaattaacatcaatcaattgctaataaaagtatctcaaatacaacaattaatatcttatgcaaaaaaatttcaactagataaaaaatcagtaatgctaaatttgatcaataccataattaatttactataaactactattaattttcttgaaaatttaatatattagaattggtattaataatactatataaaacataaatggaaaaaattaccacaaacatttaaacacaacatttaaagtgttgttattaccaaatacttactaaattttgtatttatgataatatcataatagttttactaaaaaaaattacaaaaaatgttattatctacttaaaattgcagattaattaataatgctttaagtaataacaaataaatttagttgactatatgaactaacctaatatcctaaatcttgttcagttatgtaaaattaggagttaaaattatgagtaaggatatggtagttagaacactcatgggagagttaggattaacaaaaaaggtatcaagtcaagcttatgacctagtaatgctaagtatacaaaatgcactagaaacttctcatctaattaggttacacaatgttggaacactacatgttatccaatgtgcagaaaaaaaatatcataaccctaaaactgggaagttagaaacactagctcctaagaaaagagtaagatttagatcaagcaaaaaattatcaaatgctattaaccttttagataattaattaggagcgctagcaatggcctttttcattttatgaacggatgtacctataccatgtagtacagattcacaaattaaaaaatgccctatgttaagtgctgatatgtatggtacttttgctataatagcagcactttgataatttaagccgtgtccagcatgacagcctatgtttcgttggtagcagtattctgcagcttttattacttgagatagttcactttgtgtagtattgttacagtattttccagtatgtagctctacgttatcagcagatagtttttttgcttgatcaatttggtctacatcaggttcaataaatagtgtaacatctatgttgtaagtatgtagtttttcaataaatgatattaaataagaaaaagcacgttttacatctagtcccccttctgttgtaagttcttgtcttttttcaggaactaaacagacacattttggtcttacctttattgctattgataacatctcatcagttggggcaatttctaagtttagtggaacttttaaactatttttcaatctaaaaacatcatcatcctttatatgcctacgatcttctcttaaatgcacagtgataaaatctgcaccattgcttactgctatatttgctacttccacaatatctggataatcaacatttcttgcattacgcaacgttgcaacatgatcaatatttactcccaatgcaacatctgacataagcacctctcatatatctactaccaaaatacattatatattatcaataaaattttacacaaatactatattttatttaaagcatatcctctaatctgagaagacgagatattacaaggtcttaatctaacaaacatccacccatatcggcaatttaacaacaacttacaattcgtaaaatacacattcctcatataagtagcaaaaggagtattcaaagcctgacacacatttttaccacgctcaaaaactacaattggcaataatttacaaaaatctttccacctataccaataatgaaaagaaaaaagattatcatctcccattaaccatacaaacttaacattgctaaattccttacatagcctactcacaacattgtaactataacattctttaactctcacaatatttactcttatatcactataaactaactgttgcgataaactcactctatcttcaatactataaccaccatcaaatttcaaaggattacaaggtacaaccaaccaccatactctatctatacctaaccttttaatagcttcttgactaatatataaatggccataatgtggaggattaaaagatccacctaataaacctactgttaatttttttctcataataaattcttcaatataataaacaacccacactattcacatcatcactaatatattaactgctttgaaataatccaataactgtattaaaatgcccacaagaaacacaaatttgcaacactagcattaaccattaatgaacttatcatacaatctataaagtttcttaacttgactagtacaatataagaaataaatgtaatacgttattgatcaattaagatcttcaagtataattatgcattatcaataatattaattttttaaaaatgttttaccctacacgagatctcaagaccatatattccaaagacaacacagtatgtgtagaaaatatactagaaatgatgaatggtacaagtgaagagttacaagcctataaagatgatttattaagtaaacacaaagaaaataccaaaaaaaaactagccgatcaaaaaaaaagccaagaagagatcgcattacatattgcaagtccatctttttctgaagaagcattagcctatgttaattatacaaccaaccaacacattctaaaacacttatcagacagtaaacatatagggaacaaaacaagaatattaacaaaatgtctagaaccactagaacatcaaagaagaaatatgataatggagggaatgtataaagcctcattactaaaggaatttaatcagataatgcaagatgcatctgatgacgactttgaagcattagttaacataatcatatcttgttcacatttaaaaacggatttaacagaacaacaacaaaagaacatagaagcagctatagcaacatataatagggaggaacaaggattgtcattgcaatcaatacgtgaatttataaacgatacaacaggaattgatatatctaatccactaagctctatcaagaaaaaattaggaggaaaaaaagaagatatcaaacagcctttagaatctctagatgaaaagctaattaacgtaataacatctccatacagtgtcacttactttatcctaggtactcttacacttggtctaggaggatttgcaggaccgcttttaccaatacttcttatagtcactgttggaaaaagcttacatggcatgcttacagaggacaaagaaaaagaaggaactattcatagtccctttcaagaaggagtattaaagccatcaagaatatctgagaaaccacaaaactacactgcaattttagaacaacaacataaacaagaagaagacaaacaacaagacacaagcaaacctcacaccagtaggcacttatagtaatataactttgtacataaaacgtatcaactaaaaagcatgaaacgttttgtgttatatttttaagtgataaaatagaaaagccatcatacagtatcaaataatagatgagaaaaacaatacatgcacaaataactaaatggtattagccataataatctagatataaaaacttaaaaaatgcacacaaactttattacattaaataaatacaaagtaaaaacaataaacttctcaatacagtatgtttattcaggcattatttatctcaacattctaatcaatacattaatatcatctctctgtttactgtctgcatcttattaatttttctatctgcttaacagcatgaattactgtagcatgagctctacccccaaaactttttccaatttctggtaaactcttctgagtcaatttctttgataaatacattgctacttgcctaggacgcactaaagttcttaaccttctagtagagtacatgtcagttgtcttaatttaaagaactcagcaactttcctttgaatacattctaattctcaatacagtatgcttattcaggtatcatttatctcaacattctagtcaataaattaatatcatctctcagtttactgtctgtatctattaatttttctatctgcttaacagcatgaattactgtagcatgatctctacccccaaaactttttccaatttctggtaaactcttctgagtcaatttctttgatagatacattgctacttgcctaggacgcgctaaagttcttaaccttctagtagagtacatgtcagttatcttaatattaaagaattcagcaactttcctttgaatacattctaatgtcactgatttgtgatttgcacgcaataaatcagataaaatatcactagctgaatccaaagtaatactacatccaactaatgaagaatgtgcaactactttgttaagcgcaccctctaattctctaatattggatttgatattctttgctaaaaactctaatactttatttggaatattaatacccatcttttcaacttttagctgcaatatacctaaccgtaactcaaaagttgtttcattaatatctgcgactaatccccaacctaatcttgattttatcctttcttcaactccatctaaatcactaggtgatctatcagcagatatcactaactgcttattctgatctattaaagcattaaaagtatgaaagaattcctcctgagtactgtctttaccactaataaactgaacatcatcaaccatcaatatgtctacagaacgaaattgctctttaaacaacattatatccttgcttcttaatgctgtaacatattgatacataaatttttctgctgaaagataagctatttttcttttcgaagaagattttataatataccaagcaatagcatgcatcaaatgagttttcccaagtccaactccaccatacagaaataaaggattactcccagatattggttcattagactctgccactcttctagctgcagcaaaagcaagctcatttggttttcctactacaaaattatcaaaagtaaatctaggatccaaaggagaacttaaatgatcataattatttcttacttccttatcttgctgatctttgatattcactagcaaattagtatcttgattattcacaacacaaatgtctacagaacatacactttgatcttcatcctgccaatattttaaaatttgatccaagtaatgcactaatatccattctttgataaacctagttggagcagacagtaaaaccttaccaccttcattattaatatatactagtacactcaaccaactatcatatatggcattaccataaaacttatgtaatttgacttgaatatctttccaaattacctggttgtcagattgaagcttttcttttacacaatctcctaaaagcccagtaccaccatcattcatatagccaatccaaaactacaatcataacttgaaaaatcataaatcttatagcatcactatatatagagttacgatcctctgcattatacaatagaaaaacaaagtcatctatcaaatttccataaagacactaaatcttccctaatacatagcaatatacaaccaaaaatacactcagcaaaacaaaaatatgtataactaagaaagaaatagaaacatcacgagtaaagtaaataaaaaaactcaatactataattaaaatatcacaactttatataaataatattcattttatttggcttcaatataattaatatcaggagcatctattgctttcatacctatagcatgatatccaccatcaacatataaaatttctcctgtagtacctttacctaaatcacttaataaataaagtgctgctccacccacatcgtctattgtagtattacgcctcaaaggtgcattatatttattccatgtcaatatgtaatggaaatctcctatcccagaagatgctaaagttcttactggacctgcagaaatagcattaaccctaatattctgagaacctaaatcaacagccagatactttacacttgcttctaaagctgctttacatactcccatcacattatagtgaggcatcactttttgagcaccataataagataatgttaatatactacctccattacacatcatcttctctacttttttagcaaggtaagtaagcgagtaacatgaaatatgcatagatgtcaaaaaattattcaatgacgtatcaatatacctacctttcagctcatttttatcagaaaaagcaacagcatgtactaaaaaatccatactttcccattcatcactaagctgtgcaaacatattatctacagtctcttctttagatacatcacattgcaagaccaactttacacctatagattccgctaaaggatctatccttttcttaaaaacgtcggataaataagtcactgctatatctgccccatgcatagctaaagttttagcaatcccccatgctaaagatttatcattagcaattccaatgactaatcctttttttcctttcatcatatcactagcaagcactgatatctccttattttttagacatgctcttacaatactacattaattaatatcttataaataaaacaaaaaaattcaagatgcgggagcgacgagactcgaactcgcgaccttaagcgtgacaggcttatgttctaaccaactaaactacgcccccgataaacataagatctataatgctaaccagcataagaaaggttgtcaataaggttttactttttatcaatatcacaattcttatatgcaaacctgtaggagtttaataacattatctaatatttattgcaattaaataatataaaaaaatttatacctccctactttatatgttcacaacaatgttattccatatcttagctattacagacaaatactatattttcatcaaaacaagtaccattctgtcaaagaatatccgtcagcaattacatttgtaactgtatataaaatctattcttatttacctagcacataactgatcaaaatctatatagttgaaatgacaaacacactttaaaaatcacaactctacaacccaccaattcaacaatatacaattagcattgagaaatagataaacaataaaactttatttaatatagttaatatgattttatattcatcaataactcataactattaattttctaactgctgcttgataatagaatttaccatatcagggtttgctttgccttgcgtttctttcattacctgcccaacaaaatacccaaataatttttctttaccttgtttatattctactactttacttgcattattttttaaaaccctttccacaattacagataaagcattctcatcgcttacctgctttaacccatgttcactgactatcaatgcaggtgatttacctgactcaaacatcatatcaaacacttgctttgctatttttccagaaatagtattattgactatcaaatcaagcagctgtatcaagtcttcagctgtcacagaagattcaccaatagtaattccaagcctatttagtctaccaaaaagctcacctgttatccaagatgctgcaagtttgccatcatgcttctctgcaaccttttcaaaatatatagctacatccttatcagaagataaaatatctgcatcatacttacttagactaaaatcattagtataacgctctcttttctgcataggtagttctggtaaagacgacctgacatgatctatatattgatcatcaatctttaatggaaataagtcaggatctggaaaatatcgataatcatgagcatcttctttagtcctaattactcttgtttgccctgaagtaacatcaaacaacaacgtattttgagtaactatttctccattttccaaagcattaacctgtctatttgcttcatactcgatagcttgcataacataacgaatggaattaagattttttatttcagaccttattccaagctcactacttccaacaggtttgactgaaacatttgcatcacaacgtaaagaacctttttccatatctccatcacatgtttctataaaacgcaatatcatacgtaacttcttcagatattctgcaacctcttcaatagatctgaaatcaggctctgacactatttccattaatgcaacacctgccctattgaaatctatataagttttgtcaaattcatgaatactttttcctgcatcttgctcaagatgaattctagcaatgcgaatttccttcatatcatgatcttctaagacaattttaccttctgttgctataggataatagaactgtgttatttgataaccagaaggtaagtcaggataaaaataattctttctatcaaaagctgaatacttgttaatcttacatgatagagcaattcctgtttttattgcttgataaacacaatactcattaagtacaggcaacatacctggcattgctacatcaaaaagcgctacttgcgtattaggtaaagcatcataagtctttgttgaagcaccagaaaataatttagaattggaaataacttgtgcatggacttctaaccctattactacctcccaatcacacctatttcctttaataatcgtcataaaaatatatcactttaaataaaacatattaaatcaacgctttaatagtgacaacacttcttttgaacaattaatctctctattaattacatagttttcataattatcatctattttagataattcataatgataattcaccataatacccattgaattgtttaatcccttttcagaaatatcagccatccaatttagttgttttataattgccccattacttaagtgaaaatgtgctactggatctaatgctctatcagtatttttagcttttaccaaataataagcacacaactttaaaaataaattcttgatatcttgagataaatcagcatactgtctagcattaacatatgagattatctcatcaatagatacagcaatcttaagctcattcagcaactcaacatgacttggcaaagtattcataatccatttcacaaaacctggtataggagaaagagttgcataaattttaatactttgaaactcttctgataatttattcacaacacgctttattaaaaaattacctaaactgattccagaaagtcccttttgagtatttgaaattgaataaaaaatagctacctttgcatttttaggatccttagctggtatatgagaatctaacaacatttgtatactagtagctatttcatcaacaagagctacttctacaaaaattaaaggttctcttgacatcttataatgaaagaaagaaaagcacctacggtctgaatctaatctatctcgtaaatcatcccatgaagagattgcatgcactgcttcatataaaatcaacttttctaataaagaagcaggagaatcccatgtaatttgatgcaaatccaaaaggccaatatcaaaccagtaagataatatatttcttaaatctttttctagtgaaaaaaacgattgatttttattcaatcgaattacatcagatctcatatctacaataaattttaaaccatcaggtaatgaaataaattgcttaagtatacgtaatctaggagactctagaactgtcatcaattgaaattcacattttcttttcccatcttcatctatttcacgtatataatcccctaccttctcatctatctcaaccctatcagcactaaatttttcttccaataatttaagaaaagctactttaccaacatcagatagattcaaatataaattacctagagatatagtgttatatcttgctttaatctcaccacccttcggattaacacactctttcattttttcataaagatcactaatatcctgatccctagtcaaatctttattaatactactgacccaagaaaatattgcatcagccatttcccccataactttaaaaacactatttattgtcttattccttatcactggtaatgagttatccattgtgaaccacaattaaaataaataccctagataacattattccataccattagtctattttttttagaatataataaaaacttattgactgatttattaataaaatatgataataacaactctaatttacgatgacgatacagctatgtccactattggtgtaaataaggtaattttaataggcaatctaggcaaagacccagatattagggtaatgcaaaacgggaaggagatggcaagcttctccatagctacatcggaaagctgggtagataaggcatcaggcatgcgcacagaaaaaacagaatggcacaatgtagtagtattcaatgaagggttagtaaaaattataaaaaattgcatacgcaaaggaagcaagatatacattgaagggtcattaagaacaagaaaatggacagaccaaaataatgtagatcgctacacaacagaggttatcctacaagggtttaattcagctttgtatatgctagatgctaaaaacaacacaatggataacaatggtatatcagaagattacgctactgaaagtttcaataaagaaaattcgctaaacagtagttgcgatgatataattatcgacgatgagataccattctagtcaacactctaatctactatgtattaaacatttaatcttactagaacaacgctattgcactataccattaatgttcatatcagaactctttataagttaccaacgtataacagctaggattataagaatgatatacacttcaatgaaatgtagcatacacatcaacaatcaagtttgtacttaaaaacaatcgataaccctatagtataattatacaaatacactttcatattcagcaactttcttatctttcttaagacaataaaaaccatataaagaaagtaaagcataaaaatctatacaaagtacaggaggtatactaaatttttccaaccataacaaaactgcaggagttaacatactaaaacatcctactgcaagactaaatgcaactgaatacccagtttgtctaacattcgctggaaataaaagcataattacagcaataagaggtgttgcacatatacctaaagaaaatgctacaagaaaataagttacaatagatttaccaaaaaaccaaataagaggagatatccctataataaaaaacacctgaatacagagagcaacagttgtagttttatatatcctacacagcatagtaaacagacaacacgataaagttactgttaaaatcaataaagcatacaccgacatacttactttgctttgcacatccaagaacacaaagaaagtgtaaaacaaagaattacaaaaaggtacaaaaatacatgctactataaaaggttttttatgattgaatatgacatctaaaataggcatcctagaaattttacgcttacttttataatccaaatactctctactttcttcaacagaagtacgcaacaaaggtaacaataaagacattatcaatccgataataaatggtattctccatccccaagaataaaattgagcttctggaattaaattataacacaacttaaagacaaaacatcctattgcgccaccaaatattgacactagaaaatgactacccattgcatatgcaatattacgacgatcccttacattttctgccatcaaaactacagaccctatttctccagcaaaggataatccttgtaaaatacgaaatactatcagtaaaataggcgataatacacctatagattcaaaaagaggaagaaaggctataccacccactgaaacaataagtaaggttgcagagctaaataaagcaatttttctaccatacttatcaccaacataaccaaataacaatgacccaaaaggtctaacaaaaaaagctattccaaatgtcataaatgacaacaataacgcaaaaccttctgttagatgagaaaaaaacatctgactaaatattctactaaaattcccatacactaaaaaatcataacattctataaatgcacacagaagtactgatagcattggctttaaattggaagttgtcaacatatggatagcaattaaacctactactacaataactacaatcagtagttatgcatgtcaatattattaaaaaaataaaacaattaattaagatttagcatggttacaacacactatttaagataaacactatatgcatactgaaaaaagcttacagctactagaattaacaaacaacttgtctattcaacataatacaaagtttataaaatacctaagagcaggtaacaaataactttgaaaagccagtgttatggcattttattaagtacatacatgttactaataagtactcatcatttgtgaaatttataaaataaagtacaacattatctaactctgattatgcatatgctacttcacattgcttttcattatatcgtttcaaacacaaaagaccaagtaaagagaacaacacataaaaatctaaataaaatataggagacatgctacatccagttaattctattaaccataaacaaactgcaggagtagcaccaccaaggcctgctgcaacactataacacattgaaaaaccagtttgtctaatattaaccggaaataaaaatatcaatatagataagataggagttgcatacatacctaatacaattgctaatataaaataactaactatagagttaagccctaataaatacacaacaggagatacacatacaataaataaaacttgaattaccaatgatacattttctggtttgtatacccgaaaaaaaagaaaagatataaaacctgataccaacattgtaaatattaaaagactataaattggtatacttactttctgctgtatatttaaaaatacaaaaaatacataaaataaagcattagaagctgctattaaactaaatgtaattacagaaatctttttatgccgtaatatgatatctaaaataggaactttagaaacttttttaccagatgtatactctaaatattgtttactttcttcaacagagttacgtaaaataggcaacatcatagacattaccaaaccaataataaatggtattctccacccccaagagtaaaattgagcttccggaataaagttataacacaactgaaaaataaaagacccagttgctcctccaagtattgctattgcaaaatgtaggcttaatactgcaacaacttgatctttcctaacactttctgctattaacacaatagcacctacttcacctccaaaagataacccctgaaaaatgcgcagtaccaccaataaaataggagatattacacctatggaactaacaagaggtaaaaatgcaatacctccaaccgataaaataagcaaggttgcagaaataaacaaagaaatctttctcccatacttatctccaatatacccaaataacaatgagccgaaaggtctaacaagaaaagctattgcaaatgtagcaaacgataatattaatgacaaattctcactattgacttgagaaaaaaacatttgactgaatatatggccaaaatttccatatactaaaaaatcataacactctataaaagcacacaaaaatacagatattattgcttttttactagaaccatgtgacattttagacactaattataacaagaataaaaaggatataacctcatttattctctgtgtcaatcactattaacaatacttgattttaggatatatccttactacatgctcaacaatactattctgattttgatgttaagacaaaacatttttactataaataaatatacatattaacacaaatttagtgtctaatttacaacataagctatagcacaacaatcaaataatctactattcaatatacaaattccctaccaattataaccatttaagctgtacacatacaaatgtacattttttacttatatgactttgcttatggtcagttcagttgttaaaaattatccttcataaagcactttttcagttgtttttaagtttgtattattcatatgtactacacatttgcgcataaattatatctgttgcaaataagacacacataattacagcttaaaaatgtttaaagcttcaagtatttttataatgctatacatagacctaactagaaaataatttttaaaacattaaaagatatgcttttatgaacataaaaatgcatgtttagtagaagaaaaacacacataatacgcatcaaaaattttgataagttttacattatacacaattttataaaatctataattccatcttaggaatagcaaattgacatctatataaaatatccccactcctttacacgtgttataagatcataatcagcgtatttagacatatcacaagatgcagtaaatggcttcataaactccacataatctaatattaactgttttaaagcaacttccaattttttgattaactcagtataattatctatagggactattctcatgtcttctgaacttatcttccaatacattaaccctgagatctccttttttaagctctgctttactgttaacgcctgtattatcatttgcaatgcaactccataattaatatctgattgtgaaggaattgcacctgtcttataatcaatgattatcacactaccatcttttaaacattctaccctatcacacctagatattacttcgatattactattgatctcccaagaaaaaaaacgttctgtaataatttcatcaacataatgagctctttctaaattaatttcaaaaaattgctcagctatcttttggaacttaggccataaaatagtttcaacttgtggaaaatctttatatttatccaacaattctgacgcagcaatttctaccaaatcttcatatctatgttgattattattgcataataaatatttatgtagaacattatgaacaacaatcccaaaatcccgcatagaaaatttttcattaatactcttacatggtaaaatatttaaaatgttacttagataaaagacataaggattctttaccaaagtctctaaagaagttgtagacaaaacattgaatgcaataaccctgttattaatatctggattaggttgaggccttaagtatgccaaactcttagtatcatcacatgaaaatctatcactgatttttgaataaatttcacatttcaaattttctatatcataaagttttgctaaaattcctaatcgcctaatccaaatagattcttcatttattttcccaaaactttttaaagattgtgtaatataaatcttatctgcataaaaaaaactatgtaacaaatatgcaaaataacccttttctctttgaatggaaggcaatcctaattttgtacgtatccacctgtttaacaatgttccacatgaattaacaccataatttatttcattaaacccagcaaagattactattcctctcttaaacaagttaacagtggataatttataattttctaaagaaaagctactatacaaaactgatgttaaaatttcataatatacatccatgccatatacttttattccgttacatgagttttgtaagtcgtcaaaaaattcttgaattttactataaccattagaatcaattacaagattaccttctaataaattctgtatacatacaatatgagctttcactatagaagatataacatcatgttttactttaactaaaggaagtataacacttgttattttttcccaaaaaggtagcaaatctggcaccttctcctttacattattttccatgctaaaaaaatcataaccagaataagatctgataacttttagttcaaaacttgatattaaagcatcataatcttctttaacatatcccaaagtcacaaaaggatgtttaagtaatgataataacgggataggattccatttactcattacaacttctaatgtatgtaatataaaggataatatcagataaccaacattaggtttatctaacaatctttctgcatttacaatagaatttattcttttagtcaacaacaaattatttgtaaacacaatagggctgctgttgacattttcttttataagcatagatacaacttgagcttcctcttcatctgaaatacaagtaattaatttaacacgactataatcactatagttctgaatctcatgttgatgatatttctctaaaaataaattaaaattaaacacactgcttacaaatacagaatgatttggctctcctagaaaaacaatatcatttctattaaccttcaaaatatctaataaactcttcacataatactgataatgacattcttctaatagctgccaatccttttcatcaatacttatatctacatatggaaatattattctactattaggtaatttatacaattcctgaataaagttaacaaaaaaattgtcaaacaccataccagcaaaaatcacagtacaatttaatacttcatcttgtaaatacttaattaagttgcctatatataaacttctatgctctaatatatctaatacttcatctttatttaaaacttctttccactttttagataattcagaaaggaatctagctgccttttgacaatgtgctggtaaatcataatcaaacaaacattctaaattagatattggtatacaatgtacatgcatttcattcaacaatgaagataattcataacctaaagacagtggataattatcaccattttcagaattccacaactttataaactccattaacaacaaaagcttccttattggagtcataattctgacaaaactgtgttcattagctagtagatcttggtctatatctgatagtgacataactttcacttgagcgagaacagtagcatgaaaataaagtttcaattgaccatatagcaacttaacatcttcttgatttggtactataattattacactagaagaatttccagaattatcattaaagatatcaaatgcaaattttgcaactacagctaaaaatgattctggacaataaactgaaaaaatttttcccatgaagcacgctagaccaaaaattattaaagtataatgctaatagtatgcttaacaaattaggttagtttttacaacatttatagttacagcttttctgaaaacactataaaagctcacaaattatctaattaaaaaataagttgatacttatcaatcaaatgattaaattagtacacacatgtaacacaataaactaacaatatgcaatttcctaatactagattaagacgtaaacgttcaaatgagtggttacgtaatttagtaagagaaactagtttatctatacacgacctaatattaccactgtttgtacatgatcgtgatggggtatcagaacctgtaaaacaattacctgacatcaaaagatactctatccctgaattattaaaagtggtagaacatgctgcaaatttaggcataaatgctatatcgttgtttccagtagtagaaacccatttgaaatctgaaaatgcagaagaagcatttaaccctaataatctaatatgcagagcaataaaagaagtcaaaaaacacataccaactattggcataatagccgatgttgcattagatccttatacaatttcaggacatgatggaattgtaatcaacaagcaaattgataatgacgcaaccttagaagttttatataagcaagctttagtcttagcagcagcaggttgtgacattgtagcaccatcagatatgatggatggaagagtcaaaaaaatcagaagtgctttagataactgtaatttccaagatgtatgcatactatcttactctgtaaaatactgttccagtttttataaaccatttcgtgaagctgtaggatctcgctcaatatcccaaacaatagataaaagtacataccaattagatattgcaaacataaatgaagcaatacttgaggcacaaatggatatcgatgaaagtgcagatattattatgataaaaccagggatgccatatctagatgtaattaagtccattagtagcagatgtcagataccagtatttgcataccaagtaagtggagaatatgcaatgattaaagctgcatcacaaaatcacttgctagattatgattctgttatctacgaatctctattaggatttaagcgtgcaggtgcaaaaagtataattacttacgctgcaatagatgcagcaaatatactcataaaaaacaaaatgtaagaaatctacaacatactatttaatacatcaaaacacaaaagttaggtgttcatacttgtaattctctaaatattatagaatggaaatgtatcataacttattatagaattaatgcggtaagtatagaataagtcagataagtatgtacaattcatcaatctttatttcccaattaaattacaatcctgaaaatattgattacaactatgatagcattacaaaatcatatcaagagtcagtatatcaagcagcagatatagccatattttcaagatacgcagtatcaggacacatacaaaaaattccaactttacataaaaattttttcaatcaatgtactaatataataaataaactagcactacaaactaataataaaaacacagcaataatcattggtagcataaaaaagaaaaacaatgtcatatttgaaacaatttatctgataaaaaatggagaaattacagaactaatagaattccctacagattctcaatcttctgatatctcagcaacgtttacaattaataacatcaatgtattgctacttcctatctcaaaaatacctaaattacctattcataataatgacacgttattactgattatggataatacacaatatacaaaaaatacaaattctagagatgatttaatttcaaagttaacattcaataaatacgcagtctatattaaccaaataggaggatacaacaatttagtttttcatggaaaatccttttttactttcaatggtcaatacaatttcttaaacatgtggcaagaagatagtaaagtttgcaaagcagatttagcaaaacaggacaaccataccataacatccaacagcattgaatcagattaccaagcacttatgttagcattaagagactatatatataaaaatgctatgaccagtgtaatcatgggattatctggaggtatagactctgcacttgtagcttcaattgcagcagatgcgcttggccctaataacgtacattcactcatgttaccaacaaaatatacatctcaaatgagtattactgattctaaagaatgcgctatgagattaggtatttcttacaatatattatcgatagaagaaatattccaaacttcactagcagcattacaaaatactttcatagacactcaagaagatattactgaagaaaatttacaagctagaatcagaggtaatatattaatggcattaagcaataagtttaaatttatgttattatcaacaggtaataaatcagaattatttgttggttatgcaacattatatggagatatgtgtggaggatttgctccaataaaagatatatataaaactagagtatacgaactcagtaaatggaggaataaaaatataccagtaaatagtttatgtaaaaaaattgacgttattccttctcagattatagaaaaacatccatctgctgaactacgttacaaccaaaaagatcaagatactctacctgattatgcaatattagattcaatacttacattacttatcgatcaaaaccattctacagaagatataataaaaaaaggatataatattcaagatgttaattatattatacacttaatacaaaaatctcaatttaaaagggagcaagcctctactggaccactcatcaattaatttaggcagaaaacagtgaaggttataaaatcattcaatatcccttatttaatattaaacttatatctgcaatattaaaaacacctaccgttacaaaaaaatcaatattacaaaacctataaccttttgatacattgagtaataagttacacgccaccttccaaaattcgtcaacattttcttattttcatgatactatactcctgtacaattcaatacgacaactataggaagcaagatatctcagttgctatacaagtagttttttctcttaacaactcaatttttagtttatagcacagtcataaatttctaagccaattccactattcattactactacagtgatagctaacctctaatattcacacatcacttagagtagttgagtaaaaaacaattaaatatgctaagttaataaatcctcatttgcttttaatttactcattaaatcttctgccctatctaggactgattgtgggaatcctgctaattttgcaacatgtattccataagatttattagttgatccaggtataatttcatgcaagaacactacttttccattccattcttctactttcatacaaaaacactttatattttctaaatacctatctaactttgacaattcatgataatgggttgcaaaaattgctctactcttgttaacattatgaatttgttcaataaccgaccatgctattgataatccatcatatgttcctgtacccctaccaatttcatcaagtattacaaaagatttatctgtggcttgattgattattgcagcagtttctgtcatttctaccataaacgtagaatgcccagatgcaatattatcagaagcccctactctactaaatactttatcaataactcctatatgagcatgttgagcaggaacaaatgatccaatatgcgctaaaatacctatcaatgcattctgtcttaagaaagtacttttaccagccatattaggtccagtgattaaatgtactctttgcattaatgaaaggtcaatatcattagctacaaatttcccattacgttcaaccacaggatgcctacctttttttatgttaaattcataactatcatcaactataggtttagtataagaatattgtattgccaactcagcaaaagaagttagcatatcaatttcagcaatagcatgtgcagtcatagtgattttatctgcaacttcaataatacatgtacataattgaccaaaaatttttacttccaaattaatcgctgcatccctagcagaaattattttactttccaatgcttttaattcacttgtcgtatatctaatactatttgctagagtttgcctatgaataaagtctttatcactaatcaaatagcttgatgaaacttcaacataataacctaaaatattgttatacaatatttttaaactttgaatattagtaatattacggtacttatcccgtaattcttgaattaaatcattactataactttgaatatatatatattctgacaattgtgcatcatagtcaggattaataaatcccccatctttaacattattaacattattcggtattaacacatcatcaagcgttttacacaaatcatcatatttacccaaccttgaacaaaaatcacctacaacactagaatcaaacttatgcaataaatctaataatacaaaaattttgtccaaagttaacttcagagcatataaatccttaggtgaacatttaccaactttaattcttgttaaaatacgctctatatctgcaataccacgtaatgtttccctaacacccctacacaatgttctatcatttacaaaaaactcaacaatatctaacctacgatttattgcatgagaacatgctaaaggagctgacaaacatcgttttaataatcttccaccacatgctgtaatagtataatctatagaagaaattaaggatccttctaaatctccagattgtgtacaaaataactcaaggttccttaatgctgctgcatctataaacataaaatcaccctttgaataagcttttggaaattccaactgaggtagattccctttttgcgtagctttaacatattccaacaaagaaccacatactgctatctcttcattttttaaatcacctaatccttttaaagtagatattccataaacattacacaaagtattataggatctactcacatcaaaaaaactacccgaatattgtgtcaccgaaaatttgtatttccttaaaatagaatatatagaatccaattccactaacttatcagaaatcaaaacttccttgggattaattctgaacaaatcactatcaagcttatgcaattctgttgtatgataataaaataacccagtagacaattccaaccatgcaatagcataattatggtcaacattaactatacaagataaataattattctcttttgcttcaagtaaagaatcctctaatatagtccctggagtaactattcttacaacatcacgttttactaaagccttatatcctcttttcttagcttcttctgacgtttctaactgctcacaaattgctatcttataacctaattttaccaatctatttaaataagattcactactatgaaagggaacaccacacataggtacattcccctttttagttaatacaatatttaatattctagacgtctctattgcatcatcaaaaaataactcataaaaatcacctaatctataaaataataaatactccttatattgactcttcagcatcatgtactgctgcattataggggttatcttgctatcatgattcactttttacctattgttaacctttatcttacagtatattatacgcagtaacgataaaaagataatgcacaaagtgaataataaatattttaataaaaatcttaataatacataatgacatattaccaattgtattttataattagtaaatatgtagcttgatctaacattaattatggtatccagatgcttactttcttaaagaaaggtgcaaatgttgttataaaagcagctataacacccaccactagtaaattaccccatcaagaaagcgtaggtaaataccttggaggcatgctgaaaagtattattccaggtcaaaaagatcctgctgagaaacactttgacttaagaatgcacaaccgtacccacaaactgggggtagaattaccagcaagaacaagaatagatggtcatgagcaagaagtagctctgaaagtaccatcttataaattaccatatcaaactttacaaaaattcgcagcatggcaagaacaagataaagaaggagaggtagaagaaactaaaaaagataccttaacatcacttattaatcctgtatcagcaactcaagagttcattagaagtaatactgctgataaatattttgaaaaattaaaagcacttgatcagcaattgaaagaaataggaggaaaagttacagtaaattctactccaggtagatataaacaaggattaactatagaattagatgtttccaacaaatcaagaatagcaatagagaaagatgtacgacttgttctagaaggtttaggtataaatgatgaagaattagtcaaaacttttactaaaagactatataaatcatctactgataaaaaaatgagttcagcagatattcacactgagaaaactagttctaatactgatagcaaagacaattctaataatcaagatcatgatatagtatcaccagctaaaagacatggaagtgatacagtatcagcagtacaaaggcaaggagatgatatactatcatcatctcaagaacagagtagtaaaactggatcaccaactaacagtactggtatatcaaacagtgatttttcacttacaaatcctcaaaatatgccttattctaggacccctatgcagagttcacaaatgctacagcagttgcaaaatcaaatattgatgcaacaaaaacctgaaaggatattttcacaggctatgcctactgttatgcaacaagaaatcgatgaaatagcagaagatttatgtcaaggtcttaatgaagggccaacacaaggtaattcaaacaatataggaaagcattttagtaatccaggaaaagtacatgcaagataatacttcttatgacaataacaacgtttttgcaaagattttaagaaaagaacttccatgtaacgtagtatatgaagatgagtttgtattagcatttcatgacatacatcctcaagctcctatacacattctagttattcccaaaggcgagtatatatcatttgatgatttcagtgattcttcagcagacattagacattttttttctattgtaaagaagattacccaccaattccaattagaaaaaactggatatagaattgttacaaatcatggaaaacaaggaggacaaattgttccacatttccatgtgcatattttaggcggaaaacagctaccataataaatcagctaatctactactagtaatgtgtgtacatcatacaagtacttacccatgcaacacttattataaaatcataaaaaattatatagctttaccaacaatgaacatagttcattagttaacatgcataatattacaaatatttaataatatgcatacttgtaataaaccttatatatttacttcaaacccttactgcaatagctaatacacatatgcttcattaaaaactaatcatacaataagtaaatatcttactcaaaatacaacatgctaaatttgttattaaaaataaggtaacaataatcacttaaagtatcttgtgtttaatgtaatattcatttgacaacaaaataccaatagatatactaaccttgtttgaaatatgtgaggtacagtatgtacagccttatgggtgtttttacggcattaattacaccatttaaggatgatttttctatagatgaaaacgcgttttgtcatctaattgaagaacaaatcagtaataatattcatggtttagttccatgcggcactactgcagaatgtcctactttaagctttgaagagtactgcaaagtaatcgaattatgtgttaaaatcacaaataaacgtgtccccataatagctggatcaagctcaaattctacacaagaagctattaaacgcacgttatatgttcagtctctaaatgtagatgcagctttagtagttgtaccatattacaatagaccaagtgatgaaggaatatatcaacattttaaagcagtacatgatgcaactaaccttcccattattgcatataatatacctaatagatctgctattgatgcaagcgatgcattacttgcacgaattttatctttgcctagaataatagggcttaaagattcaactggagatgtaagtaggcctcttaatttaaaattattactaaataaagaagtagttttattctcaggtgatgattctacatgcttagggttctatgctcaaagtggtagtggtggtaggactggatgcatttctgttgtttcaaatgtgatacctaaaatacatgctgatatgcacaatgcattccttgctaataatatgaaagaagctatgaatgcaaatttatcagtatttaaattagcaaaagcattgttttgtcagtcaagccctgcaccaacaaaatatgctatgagcttaattaaaaatatctcaccagcagtaaggttgccattagtggaattaactcaagaaaacaaattaaaagttgaaaaaacgctaaaagaattaaagttaatttaagacatattcaataacctggggttatggtaataagcgttggtagtttgtatattatgctttttattatctaatatgcttgacatggtatattgatgtggaatataatgcagtataagtttcacagctcccttcaaattttcctattgtaatatatctttcttacgctgtgactttccacataatcagcattcacatcaacggagcaaaaatgacaacatcaatgctagaaattcaagaatcactacataatcttacatcttcatgggaagagtttaaaaatctaaatgaaaaaaaattatcagatataagtaaaaaaagttctacatacccatccatattagaaaaattagaaaaaacagaaagcatgctagaaatacaaaatgaaagattggatcaattagaaatatcatcacagcgccctgttacccatgataacaaacactataatgaagattataattataaaacgttcacacaatacctatgtaaaggcactaatcttcaaggtcaaagtagtgttgtgcagcccttagatgaatcgtactttataccacataacatatcatcttatatagaaacaaatctaactaagaactcagtaatgcgtcaattatgttctatagaaaaaatatctggagatagtttagactgctttatcagaaacaacaatgaaaagtctgttaactggagaacaagcaataacgtagaagatacagaatcaccaaaaattgataaaattactatcaatttacatgaattatatactcaaccaaaaataacaaagaaattactagaagattctactatagatgtagccagctggttaattaatcacttagttgatgatttcagcagagcagaaaataccgcttttatatctggtgatggaaacaacaagccatatggtatcttaacatatgcttcagacatagaaaataacaccataacatctacaacactaaatagtgatataattatcaaactttattattcacttgatgaatatttctccagaaaggcagcattcataatgcacagaagtgtactacaagaaattagatctttaaagttagcatctggccaatatatatggcatccaggactaacatcaggaagtcctgacacattaatggggttaccagtatatcaaacatccgatatgcctcaattagacaataaaacattaccaaccatagcacttgcagactttaaaaatgcatataagatagtagaaaaccgttcaattaaaacattaagagatccttttacaagcaaaccctttgtcaagttttatacaacaaaacgagtaggaggagcagtcattaataaaaatgctataaaatttttaacaataaaataaaacacagtagcattttttctacatcaaaacattatctaaatattttttactaagaaatacaaagaccacataatacctttcaatccttatatttaacaaataaagatgcaaaacattatgtgtaaaaactagaaaaacaacacaaacctacatgcccatagcatttgaatattcatttcaaatatatgttgctaataacaatcaatgctaccacattacagtattagagttattatataaaatagtgcatactaaaatctacacaacaatttaccataataattctaatactacacttatcactatatcacctatctagaaaaccaataatacaaaattactacataataccctatccatatttatgcattattagtaataatcaatacatgttcagcatttatacatttaacaaatttttcactacaatttattaaatataactcaacataacactataaaatttattagcaaagccaatacatacaaaaaattctttcattaacaaccaaagaaattttatacattcaaattttatatagatagattttttgcaatataaccgtggctattactcatcacacatatctcaacttaacacatgcaacaaaacatcatcctgttccttactatgcatactcgcatatccagctgcagtagcagcagaagcaggacgggaaacacatattggtcgcttagattgtacattgattttcattaaaaccttttcaatataactattaacaaatagccacgctcccatattcatcggctcttcctgacaccaaactacctctgcattctgataatttcttagttcatttgctagttgttcttctggaaaaggataatactgttctaaacgtattactgctatattatctatttttcgtttatctcgagcctcaattatatcaaaatatactttaccactacatattacaactctacgaactttctcattactacataatgggtatacttcaccaattacaggaataaaagatccagcaaaatctgataactttgatactgccattttatgacgtaacaaagactttggagtaaacacaacaagaggtttacgaaaatctctacatatttgtctacgtaatacatgaaaataacttgcaggagttgtacagtttacaacttgcatgttatcttctgcacataattgtaaatacctttctattcttgctgaactatgttcaggaccttgaccttcatatccatgaggaagtaataacactaatccactacagcgtaaccacttagtttctgcagaagaaataaactgatcaacaataatctgtgcaccattagcaaaatctccaaattgcccttcccatataactaaagctgcaggagaattagtactatatccatactcaaatcccataactgcatattctgataatgggctattaagaacttcaaaacttgcttgtggcactcctaaattattcaaaggaatataagtacttcctgtaacctgatccactaacactgcatgtctatgtgagaatgtacctctaccacaatcttgaccagataacctgaccttaatattttccgataacaaagatgcaaaagctaacgcttcaccagttgcccaatcaatattttcaccagaagataccatatcaaaacgtgtagataacacccttaatatttttttattcccattaaactctttaggaacatccactaatgcatgggctaattttaataacttttgttcatctacccttgtgtcagataaataatctgcaaaattaccaggtacaggtcttctaaaattagtccaatttccctttaaccaatcagcttgatcaggaacatagttctctgactgtacaaactcttcattaagcatactattaaatttagctttcaagattttgaattcttcctctgtaatgacactttcactaattagctgctccttataaagagtcataggagttttatgcttcataatacagtcatacatgacaggttgagtaaacaaaggctcatcaccttcattatgcccataacgacgatagcatactatatcgattaccacatctttgttaaatttctccctatactctatagctagcttaacagctgctactacatcttcaggagaatcaccatttacatgaaaaactggagcatctattaattttgcgacatctgaacaatagaaagaagatctagaatctttaggatctgtcgtaaaacctatttgattattaactactatatgtaccacaccacgaatctcatatcctgccaaattactcaaagttaatgtttctgcaacaacaccttgaccaataacagaagcatctccatgtactaatactccaaatatagaagatttatcacattcttctaatacatcttgttttgctctaattttccccataacaactggattgacagattctagatgagaaggattaggacataaagacaaatgtacagttttattggaagataattgacgatcagaagaataacctaaatgatatttaacatcaccagaaacatctatatcctttggatatgcagttcctcctttaaattcatatatcatagccctatatggctttttcatgacctttgttaacacgctcaatcttccacgatgcgccataccaattactatctcacggaaattgtacacagctgacaagtcaatcatttgttcaatagcaacaatcaaagaatctcctccttcgacagaaaatctcttgtatccgggatatctagtatgaagtaactgttcaaaacattctacttccattaaatgttgcaatattttcttcttttcatcatttgatattccgttacaaaaactttcaatcttgttttgtaaccatagcctttcttcatgatttctaatatgcataaactcatagccaagtttattacaataaatagatttcaaagtattaattatgtcatctaaagtagggttatgtaatcctaatacagaattaaatgtggtggaaggcttgatatcacctaaatcaatatattcatgataatctaaatcactggctacatgcaactttaaaggatctaaatcagcagcagtatgtccataagacctaaaaaagtttaataattctacaattttagcattacagttatcaataagatccagactctttgattggtcgatagcattaatattttccgataaatgcaagttattagaaaaaaaattacgccactctagagaaacagaattactatccttttgataacacctataaatatcttctataacatctacattatcagtaaataaacaagttacacccttcatgtttttaccattttaaaatttcaataaacttaaagccattgcaagaattcatattgttcaaatcaaaatattcctgataattcaaattattaactgtacataatattataaaacacaattttgtagtactatatccacaaaactcaaaaaaactcaataatacttttattcattacagacaccagtttccgcatcattaattttaacctctttactagtattacaaatgctttttcgaaattgcaaactactgaatactaccttataacaacatgaactatcatcttccttatcaggattaaatattaaacccataacaacaaaatatacctctcatttcctaaaactatgagatttttactaaaatttactcacagcatctattatcgctcaaatacagaataatttaaagctaaaaaaattattataatacctattgcactaacgatatttagcatatgtaacaccataaaaaataatttaaacactggtacaaatatatatctaataaattagctacatgacattctaaataatcaaaatatgcttgatggatcaatttacttctgctagtattttcagtaagagttatttttcagtagcaggccagtccctgtatccttacaagaatgtatttcctattatttacgagttctgttttgcattacaaattcgctgattttctaatctgcaaatcacaaagataaaaacatctaacaatattatttaaataatttcactatgaattttacaacagcaccctcctactattttaagtacaacatatgaaaaacattgatcctgaattaaaacaacatctatcatctgaagttctgactattgcatactgcttacaaattattctacaaaacaaaaaaataatagggttgaccaactttgatcaaaacttaatcatagataacataacctatgaaacaacacctgggttaaacatagacatattaaaatatgacgctatttctggtaatagcacaaaaatagaaacaaccataaatagcaacataataaaagaagaagaaatattatctggattatatgattttgctacagtaaaaatattttttgtaaattatacaaacctaactcaaggcagtgcaatattatttcatggaaacattgataagataattctaaacaatgataaatttacagcagaagttaagagcacatttaacattctatctagaaacataggcgaccttttttcatcttcatgtcgagcacaattctgtgataataagtgcaaattaaacaaagaagcatttactaatatacacagtattactagagtagtaagtaatcaagaatttgaatgtatcaacttaataaacattgataactactatacatacggatcaattgtgttcattacaggaaaaaacagtaatttaacactagaaatccaagtccacaataaatcatatataaaactttacacccctactccatataaaatctcaattaatgatagattctccatagttgctggttgtgataaaagttttactacatgtagtaacagatttaacaatggtaaaaatttccggggagaaccacatattcctgaaatacatttttaagtaataaaaaatacaaaagtaagacacaataaagacagtaatacaattactaacaacaagaatttttagaacaaaattgtatgatcacactacaatcaaacatttaatatattatcattaagaatacaaaacaaaatttaaattattgcaattcttactttctcacaatgcaataaatcaatatgtaacactaattgagcattcacctatacattgcacataataattaaagaatactatgcactcataaacacttccttcagccaattttgaactttctataggagttatatttatgtcattaattatactatcaaccattgtcaatagtgttaaagaatccatagaaaaattccttttaacagaattcagcaatattattcatcaagatacacaacataatttttcagattcaaacatccaaactaaacatataccaaaaatcaatcatttaaaaattcaaacatcctcatatggaaaaatgattcctatattatatggaagtatgcgtattgcaggtaacataatatggatggacaaaatcacaatcaatacaaacaaagatataactgttataaacaatccaaataaaaagtctacaagccacagttctatacaatatacatatcatacaagtctagctatagcaatatgcacaggacatgttaaaaaaatctcaaaaatatgggtcaattcacaaccattagatctagacacaataacttatagattttaccaaggtacagaagaccaagaacctgatccactaatattaaaattaatgggggatgcaccagcatatcgtggcttatcatatatagtaatagaagattttttactaacagatccaaaaattcctaactttacattcgaagtaacagcacaatctactaatgcctcttatcaagaacatataacacaaaaaatcaaaagtatacacattataccaggctctggagaatttgcatacgatacaaaaatacaaatgaaaatttttcaacaaaaaattggtaaacagtacattccttatggaaaagcacaacaaattaataaccacagtagacatcaaaaagcagatgctttaatttccctagatcaattacaagaaagccttccaaatgtacagtggatatctgttattgtaaattggtacacagatagtttaaatattaaagattgccatatttacccagccgttgagttcaaatttgatgctactacaacacctgacaactggcatgtagcagaaataaatagagaaacagcaagacaaatttctcaggacaacattataggcggaactatcaatgataaatctttaattagatatattaaagaactcaaaacacgaggttacaaagtattactatatcctacgatcatagcagatattcaagaagattcatggataggcaatcttactggagacgcagaatatataagcacattttttaatgagcaatataacccatttattaagcattattgcaatttaactaaagacataatagatgctattgtcattggttcaagttttatcggtttaactagaataaaaaaccatcacaaccattatccagcagtagatgaattaataaagctagcaagttatgtaaaaaatcaaatgggtaacaacattattgtaacatatgcagcagactggagagaatatcactcttacaacggatattacaatatggacacactatggtcatcaaaagacattgatgtagtaggtataaacgcatattttccattaacagatattcctcaacctatagatggattttcagaacaagacataatcaatggatggtgttcaggagaaggatatgattacttctatactaatccagaaacaaaacaaggtaaaattccatatactgaaaataaccaccaatattcctggaaaaatatcaagaaatggtggagtcaatatcacattaacccagacaataccatcaccacttggattccaaaattaaaaaaaatatggtttactcaatatggatttcaaagtatagacaactgtacaagtcaacctagcgtatccatagattatcaatacaataaaaacccaatcttttcaaaaggacatgtaaactttcatgcacaaaaagttgcaataaacggtaccatcaaaacatgggacaattctgatatagtagaacaaatgtttctttggggatgggatataaggccttatcctcacttcccagaactaaaaaatacctggaaagatgcaaaaaattggcaaaccggctattggatacaagaaaaattatccttgctcgaaatctctcacataatctacgatttactaaaaagcacagggctacaaaataatcaaatcaaaatacaaaacctacacaatgaaatagatggatatataattactgaaagacaatctacaaaatccatattaaatgtactaaaagatttatataactttgaaatagtcgagcaagataatacgttagctgttattcaagaaaatcaactgcttctatacaatatttcatcaaatgatattctatccaacgataaaaacaatagtcagaagattatcaaaacaaaagcatcaaatttagttcatagcattaacttcatgtatattaacaaaaatcatgaatataatgtaagttcacaacgtgtcagaatccctaactttgaaaattcaacaatacaagacattcaagtaccaatcgttttaagcgataatcaagcaaagactatagctgaaaatattctaaataaaaaatcaaacaataagtataatttttatcttacattaccaataaaatatgtttggcttaatactaatgatataattcaagtagaatataatcatgttttatacaaaataaaaattataaatatctacttagaaaatatctcaatcagtatagaaggagtactttacaatagttcattaactactcaacatcttattcctgacaatgattttaacagttactctgataaatatattatagaaaacccaatacatatatttgactttccatgtattcacaacatagacaatattctatacttcgcaatcaccagaattaaatcagtctgggaaggaagtattctatactcatatgaagatcaagatgaacactacaaaaacgttttatctatagatacagaagcaactactggaattactattagtaatttaggcattggtccaattgctataccggatcaaacaaataaaataacaattttcctcaagacaggacaattacattcaatcaaatccttatttatggataacagtagcaacctagcattaatcggagatgaaataattcaatttcaaaacgttaaacaaatcagagaaaatatataccaactaagttatatgcttaggggaagatttggtacagaaagacacattgatcaacatcacaaaaaagaactttttacattactagataatcttccttatctcaaaattaaccaatcactaataaataaatccttaatatataaggtagtacttaaaaaatctacatcttatgctaaacaatcaacatacacatattacgcaaataacttaaaaccattacctgttacacatgtcaaaggcaatcgtgatatatacaacaatctaacagtcaactgggtaagaagagcacgcattaatggagaatggaacgataatactgacacacctatagacgaaaaattcgaaagctatgatattgagatttcagacaaccagaatatagtaaaacgtacaattacagtcaaagacagtacaacatttgtatattctgcccaacaacagaaaatagattttaattcaatacaagagaaaataaatgtgacaatataccaaaactcttacatcataggaagagggatagcttataaaactactttgtaaatgcaaaaaaattatagtgtagataacttatacaaatcccatgtttttaaacaaaataaaaagtgctaaaaatacctatagtttatcaaacttaccaacattcattctgaaattctattataatatcatgattctaagtactacgtaaaaactttatacatttcaagtaataagtcttaatctacaacaatatctactcatatacaaaactaatattttcaataacttaaagcattaataagggaaattatttattagattaaactcttaatataacctgtcttacaattataactgcgatcaatataaacattgaatacataactgtactcactttttataaatattcaataacttaacataataaaaattattgtattagttcattaatcattatattcttaacagagtaaaagcagttatttagagttaatgcaaggtttatacatcaagtcatatggctgtcaaatgaacgtttatgactctctaatcatggaaaatataataaaaccccttggattcactgtagtgaatgagccatctgaagcaaatattgtaatattaaatacgtgtcatattagagagaaagcttctgaaaagctatattcagagctaggtaaaatgagaaaaatacaagaaacaaaagacttaactatagtagttgctggatgtgtagcacaagctgaaggagaacaaatatttgcaagagctccatttgttgatatagtggtaggtcctcaaagtatacatacacttcccgaacttattataaaagctcgtaggatgaaaaaacaagttatcaatattgatttccctataatttcaaaatttgatgcaataccagtagaagagtacacaaaaaatcaagaagtttctgcttttatttcagtacaagaaggatgtaataagttttgtacattctgtgtagtaccttatacacgtggtgaagaatactcaagaactgtagaagcaatatttaacgaagcacttgttttatcagattctggagtaaaggaaataaccctaattggacagaatgtaaatgcataccacggaacatataaaggatgtgaatgggatttaggaaaattaattcagtatcttgcaaaaataccaaatatagaacgtataagatataccacatcacatccacgtgacatgcaccaatctctatatgaagcacatagatctgagacaaaactaatgccattcgttcacctaccaatacaatcaggctcagatagaatactaaaaaaaatgaatagaaaacatactgctgaagaatatatagatattatcaataatttaagaaaacaacgccctgacattgctttttcatctgatttcatagttggatttccaggagaaacagaagaagattttgaacatacaatgaaattagtacaagaagtaaacttttcacaggcatatagttttaaatatagtccaagaccagggacacctagtgcagaatacccaaatcaaataccagaagaaataaaatctcagcgtatttttagattacaagaattattaagagaacagcagcttgcttttaatagaaacatgattggtcaaacttgttctgtattgtttaataataagaaaggaaaatttgataatcaaataataggtaaaactgaatatatgcaatcctgctacattaacacagataataccaatcaattttataatagtatattacctattaaaataatagacgcttatcaaaatagcgtaaccggcatagttgttaattgataaaatgcaatgcttttgccgtaaatataattttaacatctaaaactttctaagatacattcataatagtttctcaacaatgcttatctattaagtaataacatcaacaaataaatgagatattcacattaccaatatagatttcatacacaaaaaaattccttaagatacaccaaaattctataatatcaggtacatgcaataacattcttaagatatacataaactacaacagtatattataaaaaacagatatccatctaacatttagatttactaattgtgaagacaacatggattttgcatactaaccgtactaaaaattccccattacataatacaaaatttaccaagaatcaaagtagcttctcataccctataacacatactattaaattttgaaatacattatactaaccaacatatcataaagtttccacattggacaacaaacgagaaaggacaaatctggaaagttatatatgcatttatatcaacatatacaaatagtttatcaatattctaacgcattatatactaaaaaaatacctcagaaaaattacaaaaccctaatcctacagaaagtatcacgacaaaaaaataacaaaataaacgatagaaaaataagcactggcataaaaaagcttatgtgtattatatcatatttattttgatattccaaagcaagtccaattaaaaacataatgacaccacctacaatacacatcagtccattaataagtgaacaaacagtccctactttatctttatccacaacatctgtaccaatagaaaaattcaacatatgtccaccagatgcacatccaaatataaatactaaaaaacacaaaaagtataaattactactatataataacaaactaagactaatacattgtaacaaacaaaaacccataagcacatgttttctattttccaatatattagaaattgcatttactaaaggacaacctatagcaaaacctatccatataacagaatgtataacaccagcataatagccactcaaattcatagccattaataatttttgtccccacaatatagctattgataagaaaactccaaacatagaactaccaactaccgtaaataaccatatgtttcttacctgtagtatttcaacaatatgtttaaacacttgtaataataattttatgatatttgtattcccactttttactagatatgttgacttcgtactattttttagaaacaacgtaaaaatgagtataataatttcagcatattctatatacctaatgatatctctccaagataaccctgacaaagtcaaatatgtatagatatattccattaataaagaagataaactatacactgtttgaactagtccaaacataatccctgactttaaaggggaaaaaaacttataactaatataacctgcacctacaaagccaaaagatgcccctaatgctaaaaaaatctgcgatacaaaaaaacaaatagtataatcagcatgagcaaataaaaaagttcctatagatgttaatataacagatattgatagtacttttttttcattataacaatctaatattgaaccagtaaatagctgaaaaatggaaaaacaccacatatgaattgatgccgctaatgcagtttgtgcaacatttaaatttaaatcttcacctacatatgaatttactatagcataagctatttgaaaattactcccacaaataagtactaatacccctataatccaatttaaaataggataaaaacacatttacattatcttcataaattattaacaaaaattttctagaactacttataaatccaaacataacttttagcgtagtaattataatattaaccaagttaaacacattataaaattacgatacgccaactaatgctcactacttaatatcaattttacaagattcagtatctaataagttttaagattactttaacctgatacaaaatacttaatcaatttatattattgaacatacaatttataatcattttagatctataaaccctatattaatttatacctaataacaacaactatcctataattagcttgataattaaaccaagtactattaatgcccatataacatctctactaatacttgtttttgctttacttagctcttgatagttatttattaaatctaaacttttatcaacttttttcataaataaaggaacatcatgtatagcttgacacaagtaagatctttttaatttttgaatatatttatttttttcaatagcatacttttccatccataattccgctattttccacatattaacttcaggacacaattgcctacatacaccttctatcaatactgtagttttttgtaatagaaaaagttggggttgcaatttcatattaaaatcagcagtaactttaaataattgagttaataatgctgaaatagatatattttccgtatttttaccaactataggttcacctatagcacaacaagctgtaacaaaattactatattttgcatcaacatatccagctctataatggatatcagcaacatattgataatctctttttaagaaacctacaagtatctctgtaacatacatacatgtagctttatctaacctccccacaattccaaaatctataattacaactcttccctttgcatctaccataagatttcctggatgcatatctgcatgaaaaaatctatctctatacacttgattacaaaaacaaaagattaaattttccactagtgctttacaattctctgacttgtaaacattatatattggtacagcatctatccattctaatgtcaatacacgtcttgtagtcctagtccaatctacttctggtacataacatcccttatcactctgaatattagatctcaactcctcagcatttgctgcttcaaaacgcaaatctatttccattttacatatctcatgaaatgtttgtacaagctgtaataattgaaatcgttgcagactttgaaagttttgtgctacccttgcaagccaaaacattaatttaatatcccgttcaaaaattttttcaatgcgtggtctcaaaaccttcacagcccttacattgccattaatatctttagccttatgtacctgtgcaatagatgcagcagcaatagggttctgctcaaattcacaaaacacttcatttatcttacacttaaaatcctcctctacaatttttacaacatctacataaggaaaagctggtaatttatcacataaacagagcagatgacttgcaatttcttccccaataatatcagtcctagaagatatagattgaccaaatttaataaaaattgggccaagtttttgcatagccattgcaatcttctctcctcgagattttttcctaattgatcttttagcaaaaagataggtataaggtaatatgttataccttactaaaacacttaatatattcagtaaagaaattatattagagaaggtactaagcataagatgaaaacatttttaagaacttttcattttttacaatctcacttggagatccttcacaataaatactcctattaatacatataacacgataagaatttgacattacaaaatgtaaatcatgagaagtcataattacacttaaattatatatagaaatcaatttgttgatcaatttgtaaaagctatcttttgcattaacatccatacaactcactggttcatctagaataattatatcaggatttaacatcaaacatcttgcaagtaaaactaattgtaattccccatgagatatctccgacatttgccgatctaatattttttcaatattaatgtcttttaatacatcacttaacttcaattttcttttgctctttgtataactagaatttaaaaaatattttactgtcattggaataagagaattcacactaaaatgttgtggcaaatatcctataataaaattttttgcatattttataactcctatataatttctgtatatcccaaccagaatacgaattaatgttgtctttcctcctccgtttggacctaaaattgtaacaatttcaccaaattttacttggaagctaatatcatctataactttttctttagaataaaaaaatgaaagattttcaacatttataatatagttattgacgtactttttatcatatgcaagaatttcacttttatttaataacttatgaaacatacaatccttctcttgctcttttatatattattacatcctactataggatattctgtaccaagaattatagcaactataaacccaatatattcactagttaatgcagtcactaatggtataacaaagccagttcttttaatcaatgaaccagtatcaatacatgattacatgttaaaaccatctgacaaaaggaaattaaaggatagtgatataatattttacgtagatgatcaccttgaaacttttataaacaaaatacaaaacaaaacgttagtcaaactctcagaggtaatagaattattaccatcaagatacgattctaacttttcttataaaattcacacaacatcaaatgatctacacatttggttaagcccagaaaatgcaaaaaatatagtcaatcaaataaaaacggttttatgtaatgcagatccagaaaatgcagaaaagtattccaataatgcaaacttagcattgacacaaattacaaaacaaacagaaaagataaaaagtaccctaagctctgtcaagacaaagccttacatagttacacatgatgcatatcaatattttgaaaaatacttcggattaaattttatagcagctctttcttcaagccatgatacaaatatcagcgtaaaaaggctaatgcatatcaaaaaaattattactcaacacaaaataaaatgtattttttctgaatcttcaaatgataaagtcaagaatttatttctaaaataccaagtaaaatttcaaatacttgaccccataggcaacaccctagcagcaaaagataatgcatattttgacattatgcaaaatattgccaataactttctacagtgtctatcagaggaataacaccacataacgcatctaatataataagcttctatagactactgaagatacacataagaacatattgtataatatatataaaaagggtatatttacagactcaaaccactatgttaagtccatattctctccatggtaaaactcttatagtcctccttcaattatctaccagaaataaatatcagttatataaaacacttccagtgatgactaaaaagtccataagtatcttattacataatataataaattattaagatataatatatcgagatgataaagctgcacttaaagtcccttcgtctaaataatctatttctcctcccataggtataccacaagctaatctagttaccttaatccctagttccttaaccatttgagttatataatgagtagtaacctgtccatccatagtatttcctatccctataatcacttcttgtacattaaatttttttattctttctacaatactatccaaattcaattgatcaggtcctatcccataaattgcagacaaagtccctcctaatacatggtacacaccttgatatatttttcctttttcaaatgcccataaatctcctagttcttctactatacataacaactgatgatcacgtttagtatcagaacaaatgctacatggtgacttaacatctatattaaaacatacaggacactccttagcctgaaacgctaaatcctgaattcctgatgctaaaggcaacataatttcttctttgttacgaagtaaatgaagtacaattcttctagaagaagatggcccaaaactaggaagttttgcaaacatagcaattaacttattaatatccacaccacctccttaacaattgataagctaaacaacatcatataacacaaaatgcccatatggtatttacaatcaactatctaactcaaaaaaacctacaatgtaacaatgtactttttattataaaataataaacaagctatcatctatacaaaaagttaaagaatatcaaaatttatgtgacaaactatattagaaaaacctaacatacaacatcacaaaaaaactttatacacctagctaacggtttggttcgtcttccgttgatgcaaacttattatctttcaattcttgttttagattacgaatacctttgcctaagtcactcataacctctggtaatctgcctgcaccaaacaatactaaaattattattaaaattaaaaaaatttgccatggacctaaagtcataatagaactcctataaaatataaaactataccttaaataataaaattttatttaagtcaagcaagataaatatagtatcaccaacttgtggtaaaactacattagcaaacctcatccaacacaaacaatcacctacacaaacacagatcatattattaaaaaattttatctgttttactacagcttttactcctttatctgaatcagaaattattgcctcaggtcttatacaaactactactttttctccattagtaaaagattgtgctggtattttccctatcggtaattctatacaagaatccttcactgtacaaacaaaacgattaatctcaccgaaaaactgtgctaacatatgatctttgggactataatatatctcatatggggtaccatgctgaactatatatccatcacgcataacatatattatatctgcaacttctaatgcttcctccggatcatgagtaacaagtaatacagtaattcccttagcttttaataatgataacacatgccttctaatattaatccgtaatgctgtatcaagactagaaaatggttcatctaacaatatcacttctggtttctgagcaattgctctagcaattgtaattaactgttgttgtcctccagaaagcatatcaggatacatatctttatatgctaccatattaatagattttaatatatctagtgcaacattaaacttctgtattttaggcaaatttctaacagcaaacattacattttcaataacagtctgatgtggaaataaagaaggatgctgaaatattaagccaacattacgttcttcagttggcatacaaaagttactgctagctaaaattttattatttatatatatggaaccacaatgtaaattctccaacccagcaattaactttagtattgtagacttaccacacccagaagggccaagaagacaaataacttctccttgtttacaactcatactaatattatgcaataaaaattgaccttttttatatttataacagacattgtttaactgtaaacctaccattaatagacctttaacaagcttaatgccatatagaatgaattattcagctgtaactcacatagatatgagtacatttcataaaataaacgtcaatacttcatttagatgttaatctttttttactttcgatgcaagtaatacaaaagtactatattgcaacatattttactaaaatctctttagtacttataattaattactattaaaaaattattagccaataaaattaatgattttataccatataagtgtatactgaaaaaaacagtaagattagttattatccatacaacatttgaggaacgtcatgtttagattcatagtcacaattttactaacattatttatcaatacaaagtgctactctgcaaatctttcaaatcgagttaacatgaaactatctataggatcattagacatgaaaaccaaaaaaattgaagcagctcttcaagtgacaatacaaaatggttggcatatttattacaaaacacctggagatcttggtttaccaacagcttttcaatggcaagacaacacatttaagagcatacatgtacattggcccaaaccattagaacatacagatactgtaggtgacaacacatttcatagtaatatctataaagatattgtaatatttcccatatcattagtactcaaagataacaaacaaaaagaattaaataccactttacgcattagatatgctgtatgcaaagacgtatgtatacctagagaaaaggtaattatattgaaccaacttttacaggattatcaaaaccaacaaactatgcagttaattaacttctggaaaactaaataagtttttaattactaagaacacacgtgcttgagtttctaggttattactatttaactacctatttaaaaaaataaaacacccgatcacaggtttatagtccttagttatctaaactctaattagaaatgtaatacaaaaactataaagactcagtttttaatgaccaagaacacacgtgctcgagtttccaggttattactatttaactacctatttaaaaaaataaaacacccgatcatagattgatagtccttagttatctaaaccctaatcaggaatgtaatataaaaactataaaatttagtttttaatgaccaagaacgcacgtgctcgagtttccaggttattactatttaactacctattaaaaaaataaaacacccgatcatagattgatagtccttagttatctaaaccctaatcaggaatgtaatataaaaactataaaatttagtttttaatgaccaagaacgcacgtgctcgagtttccaggttattactatttaactacctatttaaaaaaataaaacacccgatcatagattgatagtccttagttatctaaaccctaatcaggaatgtaatataaaaactataaaatttagtttttaatgaccaagaacgcacgtgctcgagtttctaggctattactatttaactacctatttgaaaaataaagcacttgatcatagactgatagtctttacttgtctgaactttaatcaggaatgtaatataaaaactataaagattcagaattacattgctagtaaatataataaataattaccgtagtaaattctatatacaaaagaatagatatatattaaaaacacaaccataattattaattttaatattaacaggttatctatctgtaattctataagataagtctaaaaatattacattgcacaaggttaccaagtctgttataaattaaaccattcgtatgcatgaaatttactatggatacattgtatcattttccactatgtcctttttccagaaaagtacgcatctttctcaaagaaaaaaaatttaactttcatcagatagaagaaaacccctggaaaaaacgtgaagagtttataaaaatcaaccctgtatgtcaggtccccgtattaatcagtggacaacatgtgattgcagatagccaagcaatttgtgaatacattgaagaattatatgatagtatatcactacttgggaattcactatacataaggtcaacagtgcgcaagttaatatactggattgactataaattttatcatgaaattacaagatatatcataaatgaaaaagtatcaaagtattatataaaaaatgctagtccagattctaggtttatccaagcagcaagacaaaatttattgcctcatataaggtacatagaaagattactcaataataatagttggattgcttgcaatgaatttactttagcagatataacattagctgcacacatatcagttttagatttcatgaatatttttccatggcattcaacagccatattaaaagaatggtattccgtaataaagtctaaaccatcatttagcgatatattaaatgacaaagtaataggtataacacctcctgtacattacaatcaactggatttctaaactatgcttttcttattttttaactaggtgaagtacactaggtattaataaaaatattataaatttatgcaattacaaaataaaatgtataacatacaatagtctgtaattttataagcactataaaactttattaatatgaaactaaacctatctaatataaatctaccaaacggatatactttagaacatcacaaaattttatatagtacaaattacgaagcaatcaaacttgcagaatgcggagctgaagatggtacaataatcatatccgataaacaaattaaaggtagaggaagatatgagcgcacatggtactcccccacaggcaatttatatttcagtattattataacaaaattcaaagaaacgttccctttaccatttattgcagcattatctgttggaaaaacactggaagaaatattaataaataacaacaacacaacatcaaaagtagaatataaatggcccaatgatatattagtaaatagtaaaaaaatatcaggtatattgttagaaagtaaaacattgaataacacactacaaaaatggatagtagtcggcataggcatcaatatgtataaagcaccaacatatgcaacaacaatcaaggagcataatcaaaatttcaccctatctaacttagaattactggaaaaagtaataaataatttttacaacttcagaaagcattatatttatcacgggtttgcagatataaggaacctatggctcaaacaaacatgtcatttaaacagagaaataactgttaaaagctacaaacacacttacactggtcaattcattacaatagatacacaaggtaacatgttaatgaaacaaaacgataaaacaatatgcatcacctcaggagaaatatttaatatctaaacctagatgatttataacaatctaataataagacatatgtaacacaccatttataatataaaaaacgctaagctagttatacttaatgtaacataaaattacaatatatcaagtaatatgaacaaatatataataaatttttccacaatattggatagcaaagtaattttatttacatatgtactgataaaaaatactgatgcaatgcctaattaaagagtacttttacaactacaaacacaacattacgaaaatgcatgatacaatggctaatctaacaaataatttcctactatacttaattagaaaacttatatacttttttacaaacaataaaaatgtgatactaatagatagtaacacactaaaaaataaaaatattattgactgaataatatattcaatatagaatgaaggtattatattcaaggttttaattaaatataaatatgttaacgtggcgcgtgagtgcttaaatactaagctagttacttgtaggtgttttactggttgttgtttattatccaagtaatacaataacttggtgaggttttattcatctgccatgtatagatttcaatgcgtgtgtagctgcgttcttttttcttcatcacctttatttattttggttaaatagtcaaaatgcctattattttataaaaagtgcacaggtattatgtttgcacttttaaagtagctgtataacccattaactataaatgcatagtgtagttattaatagaacatttttcaattaacagggagatgagaacatgcaagggggatggacatttaacaatactcaaaggaaattttacaaagacatactgaagcatatacaaaaaaatcaagttgtgaatccaactattagacaaccaataggttatctttcacataagtttgatcagtggctttttgctgtccaaaatactcctcatgaaaagtgtgttataatcactgaggaatgccttaatacaatcattttaaattcaatagactttcaaagctttgcattagtatcagaaaaacttgatgcagattttcaagagcaatgtgatgcacaaggaatactatttttatctggtcttcgcttacaattaacaaaacacattgctaaacaagtaagggatagtggtgtaggagcaatacctttatgtgatattgaaaggctgttaaaccaaaatacaccattaccaattaatttcaatccagcagacattgactgttatagtgatttcgtagatagcatattaaatgccagtaataaagacgttctatatgaagaagcacaaaaagtacttaatatagtagctccactaactccttatattctaataatgagaggtttatcacatgcaattataaaacgtacaaaccctcactcagaaataaatcatgatgaacagcttgttatagaagctaaaacatctattttattacatacaacagctgcaacacaacttacaagagaaactcaagtatctctagctaatgaagcatttgctcatgaacatccagtacaagataaaattattagagcagctaattattttaatacataccttagtagtaccatttcatggacatatattggtagtatactctcagtattcgtaacacgtatgtatgctggatatgctagcagtagagcagaatcagatatacaatctgcattattacaagcacgtcataatgttacttttaatcatacccgcatctatcagcctgatttaaatattaacccaaatcataccaccggaaataacacagttgtttatgcccccagacacccttctgaacaattcccagaacaccaaggcgttctaaatggggctccttcttatgcaacaactctaatgtctacactacagcttacttggacactgcctaatataattctaggacaaaaaaaaagaacgtttattctcaagcatttaaaaaaatatagacctacacaagaagatcgaagaaatgataataagttcttagctacagtaatatttcgctggttcggaaatgtcattatacagcctgttgattgcgtagattctgaacttaaagatgcctttttcagatggactatctttaggttctttacaccacttgcaccaattgaagaaccattaaaaatgcgaggcctttatgctcgtcttaccaggaaatgttaccgaaatcaagaaagagagctccagataagtaacaggattatgaatagtgctagtttagcaatactggcctttgaatatttagatgtagcgctcggatttccgttcccaatatgttcagcaatattaaaaggaacaagaattgcgtcagtggtacttccagtattagtaaacagattacgtgataatataacttataacccaagattcagaaggtttatacttgcaaacatgttaagaacaggatcttcacctcttgtattaacaggttttgacctaatcggtaattcaatacgttacgtgagtttattaacagcatttgatgtaatggcaaccgtaaatgttgatgcagtatcatctagtattttatacgaagctgatgtattagaacaacacatcatgattattgaagatacagtagaaaatattatattcaccaatagaggaagcctagcattacttgccccaagcatggaaataagatttactgactcaagaaatcgaataactattagtgaaatcttagaagaagatgaagaggagttacaaactcgtcgacatgcaactagagagcacaacagtacagaaataatctacaggttaaggggagcaagacgtgtattacatcaggaagtacctggtacaatgcgggacggaatacctctattatcctataggagacgtcacagcagcagcactatagaagaaccaataataggccctgaggaaagagcagcatatttttatgaacaaaatatattgcatccaaacaggaatattgaaacaagaacacaaccaggtacacatcatgtggcatcaaaaaatctactgaattcagacatatatcttgaagcacaaaatccagtaatattaatttctcatacaagacgttctagtgtagacatttcacaagaacaacctgtagtgtttgtagaacaacaagagtcagatgtagatgatcagcctgaaactcctgaactaagagcagcatatttctatcaacaaaatatactgcatccaagaaggaatactgaaacaagcataccaccaggtgtatctcctgcgcgggcaccaacaggtatgctgaatgaaagtatatatcttgaagaacaagaaggagaaaggttaacatcttacagaagatgttctagtatcacacttacagaagaagaatgtgaattacaacaagtaattgtagaacaacaagatccagatagaggtcctcatcctacagatagtgacatcattaatctaagagcaacatatttctatcaacaaaatatactgcatccaaggagggatactgaaacaagcacaacaccaggtgtatatcatgtgcgggcaccagtaaatatgctgaatgcagatatatatcttgaagaacaaaatgaaggacagttaacatcttatacaagacattccggcactacatcttctaatcaaggaagatcaagaagatcaggtagaagtgccttaaatgaaccattaccagactctcagataagacaagcctttttctctcaactacatccaagaagaagatcaggtgatccattacaggatataataccagaaagtatgatgcaagcagagatacttctagatccagaagaggatcctccattactatttggtagaaacattcctacatgcagtattacagaaatcataactgaagaaagtgatacctcaacacagcaagcagctggagctactgcaactcctatcggaggcgcagatgatgatgataatacattaccaagttcaacacttcacgtctcttctgctacacaccacggtgctcctttatcaagataatgttatacaacatagaaggcctgaatgaaattgtaaaaccaagttcattcaggtttcctaaatctcttaactcttctttattaagatagcataaaggtacttactttctctgaaaaagtcctgaatgaaagtataaagtctaagtagatgattcaagtctttttgtaaagtactgcactcctcattatcctacataacattgttatcaattcttacaaaaatcaatagcatgtataccaccaagaaatacacataataagtacatattttctataattggacaaccaataaaaatgcagagagcatacaacaataggaacatttacatcattaacacacagatatttttataacaaccaactaataaacaaagtagtaacatcttggtacacagtaatcaaattgtacattcaacaatatcccacataacattgttatcaatactattaaaacagtaaaaaggtattaatgactatattaaaatacctgagtaaacataaatcctatgatttaactctctttacaaactgtcaaattctttattatcaagatagtaaaaatactctagctataatattgaaaaagacttcaatgaaattattaaattttatattttttcattacatttttaagtctatcaatttttaacaacagatgataatataagataaaataaccttttacacatcacatactaataaactacagttaacattaatttctctggaccacaacataaagatttagaacttcagaataaataaaaacaacaaagtaacttcttcgttacagaaatggatcaagaaaagggattcgaatcctcgacctttattttggcaaggtaacactttaccaattttaacaacagataataacataagtaaaataaccttttacacataacacactaatcaactatagttaacattaatttctggaccacaatataaagatttagaacttcagaataaataaaaacaacaaagtaacttcttcgttacagaaatggatcaagaaaagggattcgaatcctcgacctttattttggcaaggtaacactttaccaattttaacaacagataataacataagtaaaataaccttttacacataacacactaatcaactatagttaacattaatttctggaccacaatataaagatttagaacttcagaataaataaaaacaacaaagtaacttcttcgttacagaaatggagcgggaaaaggggttcgaaccctcgacctttaccttggcaaggtaacgctctaccaactaagctactcccgcacaatcttcaagtattattttggagtttaatgataaaataataactgtaacagtgcaagaaaattataataacccttccataatatctcacaataaaaactgcaaaacttaaaatttactacgataataagaaaataatgcctaaaagtacaaattggtataatattaccaccatcatacttcaagtgttattagatattatatatcaaataacatctaaacatttacaataaaaatatattaaaacctcggagacaaacaaatgatcaaacgttacagtagacctgaaatgtcatcaatttgggaagacaataataagttcaaaatatggatggacatagaatactacgcatgcgaagcacaagcaaaattaggtgttatacctgatcacatactcaataatttaaaaaacaaaattgaacattttgatattaaccgcataaatgaaatcgagtcagtagtaaaacacgacgtaatagcatttttaacatatatatcagaatctaccaatgcagatataagatacttacactacggtatgacaagctctgatgtattagatacttgcttatccatacaattaaagcaatcttgtaatttattattagataacatagaaatcatattaaacattttaaaacaaaaatctatagaaacaaaatatatattatgcatgggacgtagtcatggcgtacatgcagaaccagtaacatttggattaaaacttgcaagattttacgcagaatttaagcgtaattacaacagattaaaaatggctcaagatgaaatatcagtatgtaagatttctggagctatgggtaactttgccaacattgatccatttgttgaaaattatgtagcaaatgcattaaatcttagaccagaatctatatcatcacaagtaataccaagagatcgccatgctatgttttttgcaactttaggagttattgcatcttccatagaaaacatagcaatagaaattcgtcaccttcaaaaaactgaaacactagaagtcacagaatatttttcagctggacagaaaggaagttctgcaatgcctcacaagaaaaaccccatattaagtgaaaatcttacaggccttgccagaatgatacgaagttacgtaattcctgctctagaaaatgttgctttatggcacgaaagagatatatcacattcctctgtagaaagatgtattgcaccagatgcttgtattgttacagattttgcattagcaaggttagcaaatttgctcaataacatgatcatatatcctaataatatggataagaatctagcacaatcaaaaggtttagtattctctcaacgggtacttcttgaattagtaaaatatgggttaaaaagagaaacagcttatcaaataattcaagaacgggcattaaaaacatggaataacgatagccattttctagatgaactaaaaaaagatccacaagtattaaaatgtataagtaacgaaagtttagaatctttatttaactttgattattatacacaacatatagacacaatattcgataaggtttttaaagaataaataattaattaagttcagtttttaatgttaattaatatataaagtcattatgaagctactaagttattaatttttaaactaaatattaaaaaatataagatctttagttaagcaaattgttaattagttaaaaaaacaattaaataaaatatgaataatgtaattttatattaaaataataaataattgttattgactatttatcattttctgattacaatcctattatattaatttaaaagattaataaatacggtcctaccttactatcaatgcataaccattaggtaacacacactttatcttacaaaggtaaggtagggcctctatctaatttagacacaaactagtttaactacacacatgcctaattttatacatttctacagtttattgcaagtggtttttatacaaccaaaagttataaccaaaagaattaaacaattataaagaaagttgttgttactacttaaaccctacgcaacttattacaaacaacctttcctttttaacaaaaatcactaagattacccagcttcttttcaagaagtatatacactgaatttaataatagatgatttaaaaaccattcacaataatcaatctattaacattcatatttctgctataccattttcacatcatcaagtacgtattgcgtacctatttctaatacagtaccaatacatgcctaaaatcactctctaaatacgatatatctttagtataaacccatctctgacatacctcttcaaaaacacatatctagttacctacaaatagtcatgtatataatactatagtcagattaagccatatctaagagctattgataaaccttagccaatatattattcattctttcagcaaaatcactaacatcctgtagctcttctccttcaagaatacatgcttgattcaataataaatgcaacatgttttctaatgtaacactttccccagcattagcatgttcatctatcattttagtaacaataggatgtttaggattgatctccaaaatctttgtgctcttataattcaattgcttctgttcccttaaaaatctttccattctaatatccatggaaccatccgctacagctaaacatactgggctatttgttaattttttcgataccctaacgctactgactaatttatcaagtacttgagctgcatacttaacaaatgtgtctactttttctttagaatcaacgctctcatcttcattttccttaatttcttcactcttatcaagatgagcaagtttttctaaatcttcatccgctcgtataactgattttaaaggcaccttttgataatcagttaccacattcgtccaaaaatcatctacaggatcaactaacagtataacttctatcccgcgacttataaacccttccagttgaggactctttttcacagaatctaaatcattaccagttaaataataaatattatcctgccctgctttcattctttcaatataatcttccaagctaattaacgaatcatcactgtatgtactataaaaacgacatgctgacattaactcttcacgaaactctgtgttcatcgattcacacaatccttccttcaatactgagccaaaattttcccaaaattttttataatctttaatatcactctcagcttttttcttaagttcagatagtactctattaactatagattgttttatcttctcaataattttgttattttgtaaagtttcacggctgatatttaaaggtaggtctgaagaatctattataccttttaaaaatctcaaatactgaggtataatttgtacattatcttcagtaatgaatactttattcacatataattttactgaacatttcctatcaggatgaaataaatcaaatggtttaatagatggtatatacaataaattagtgtactctactaccccttcatttttattatgtaatatcatccaaggttcaccaccaacatgagctactgtacggaaaaaattttgatgttcttctgcagatatttcacctttagattttgtccaaatagcagcatcactatttaacttctcttcttctcccttatcatttaagaaataaactggataattaatatggtaagaatatgtagtaataatatgttctatacgaaacctatcagtaaattcagattcttcaggctttaatattaaagtaatcttagttccacgggaaatttgattatcctccagttgagaaatagtaaattctccatctccatgagatttccactgataccctatagattctccagctttacgagactcaactataacctcacttgccaccataaatgcagaataaaaacctacaccaaatttacctattagttcaacaacaccttgagaagaagttccattattaatttcatccaaaaacctttgtgtaccagaatgcgctatggtacctaaattatctattaggtcttgcctattcattccaataccattatcagatatatataatctatttttatcttggtctacactgataactattttaaaatcagaatcttggtctattaaatcttgattagatagagattcataacgtaacttatcacatgcatctgaagcattagaaactaattctcttaaaaaaatatccttatttgtataaagagagtgtataacaagctttaacaccttacctacttcggcatcaaacttcaatttctcagaatttataacatcttgcatattaaccctcttaaactagtattaaataaataagtaataactacagcaacaattttcaagttattaaattactaattctcataaatttgtagtaaatccatagcatgcttatacaccataagctcagaatctgcattaccaactatctcttttattacctcgatagcaccatctatattattattttttagcatatacactgctattgcttctttaatagatgacttataaacttcagattttgtagacaaaaatttctgaactttacttttcaataaatctaaatcctctcctttaagcaatgctataatctccaaatactctgctaactccctcaactcaggcatgagtcttttatcagcagctaaatcagcatatattgactgtgcttttgctacttcattctccccatacatacctgctaacttaaacttagctaagtactggtagttagaaccatcaactttagcaacatcattcaatatttttatcatttcatgttcactaacttcacccattaaagcatcatacatcatatcacccatacgttgtgataacttctcatgacggttatttacccatgaaaccatccctgcaaacactactaataagacaactataataccacatatccacttcatatttggaacaactttaactatgtttaaccccataaaatgtccaatcaactaacaagataatatcaatgtaaaaaaataaatgtgcatagtcaatgcattttaggaagttatcataaacactgtataacacatatccttttgatgtacatatattcattttaatactagcaaaagtatatgtataaaccatttatacccagacaaactttgacttaagcaaattacacaatacctttcttgatcaacatactcgttatgcaatattaatcagcaatgtaatacacttagcgtaacactttagcaagttcataaacttttactttcatatttacataaatcttgaacaacacactaactacacaacggctttcttgacttacacacatatctatcatgcaatattaatcaaataatacacttaacatcacactctagcaagttcataaacttttactttcatattcacataaatcttgaacaacacactgactacacaatggctttcttgacttacacacatgtctatcatgcaatattaaccaagtaatacacttaacatcacactctagcaagttcataaacttttactttcatattcacataaatcttgaacaacacactgactacacaatggctttcttgacttacacacatacctaccatgtaatactaaccaatgatgcgcatataataaccacttttttggtattacatttaacaacgcgtcctctgtctttaatacattactttccttaactaatcctatcctattacttactctaaacacatgagtatcaacagcaacagttggtaaatttaaccatgtatttaaaaaaacattagcactttttctacctacacccggtaatgcaacaagagtattaaaatctaaaggtacattactattgtgttgatttataataattccgctaagtgcaataatattcttagatttagaattatataatcctattgtatttatataattttttagtcctttttctccaagatctaacatttttcttggagtatcagcaacttcaaatagtttatctgtaatcttatttacactaacatcagtagtacgtgcagataaaactattgctattagtaaagtaaaactattagtatacttcagttctattctggggtgaggattatgctccttaaatttagtaaagagtaaatttatattccttcgattcattaatctgcatacacaacttatatattaccatcaatatcagaattatccttagcatcaattatctttgctactgaaacaactttttcacgtttctcagtcttaaataaagtaacaccttgagtacttctaccaataattctgatatcacttacagcaatacgaattagcttacctttatctgtaattaacattatatgatcattagattctacaggaaaactagctaccacattgccattccttgcagttgtcaaaatattaacaacacctactccccctctcaaagtagtgcgatattcatatgcagaagttctttttccaaagccattttcagttactgttaaaataaattgttcattttgtaccatagtaacaaatatgtcttgttctaatccaagatcacataatatcttagctatacctccattaacaacaccttcctctttaacacacatacgcttgtctaaaggaacttttaaatacagatcctttttctcagaatctatatccatagctagcaatacagacatagaaatgacattatcatctgaagatagcttaatagctcttaccccatcagacattctgcccttaaactgacgaacattacttacagaaaacctaatacttttccctaaccttgtagacaataaaacatgatcctcttccttacataccttcacagatatcaaagtatctcctgtatcaagtaccatagctattttaccgttactaggtacatattgaaaatctgaaagtgcattacgtcttaaattacctgatgcagttgcaaaaacaatattcaatatttccgcatcttctacattatcaggtaaaggcataacactagttatagattcattctcactcagcggaaaaatatttactaatgatcttccacgtgatgtaggttcacctaatggaagcttataaaccttcaacttatatactctaccaatattagaaaagaacaatacactagtatgagtattaactacaaaaagattagttattacatcttcttccttaatagcctgtcctattctcccctttccacctcttttctgagctcgataatttgaaagcttagcacgtttaatataaccactcatagtgacagtaactaccatatcttcttttggtataagatcttcaatatcggtctcaaaatgtgaataatctatagtagttctcctaggaacagctaattttgctttaatctctttaaacccatccttaatcaattgtaataaagactctttgtttttaagaagctcagtatactgtttaatcatcgataccattgactttaagtcaagttccaatttttccttttccaggtttgtgagacgctgtaatttcatttccagtatcgattttacttgtacacctgttaattgacatacattgtcaatgacaatgcttttactatcggcaacaagttctatcatctctctaacagatgttagagcatcccacttacattcaagtaaccgcttagtagcctctgctgtgtcacgagatgatctaataatagcaataactttgtcaatatttaacacagcaatgtacatgcctatatataaatgagctctttcccgaacctttcttaatctaaactgggtacgacgtgttaaaacttcctttctatactcaacaaacgtagatataatgtctggtaaagacatcacttttggtttattattatctaatacaagcgtattaatactaaagctcgttctcaatggagttaatcctaaaatttgatttaagataacctgatgagacacctgtttctttaattcaattgcaactcgtatccccattttgttagattcatctcgtaaatctaatatcccttctatctttttttctttgatcagttcatggatacgctcaataagttttgccttatttacctgataaggaatttcatcaataattattgcttgctttccagacggtaaatcttctaaatgagttttcccctgaataataattgttcctttacctgtcataaatgcagaacgtataccagcatcccctaaaatagtaccaccagtaggaaaatcaggaccacgaactatattaattaactcatcaaaagtaatttcaggattatctatgtaagctatacaagcatctattacttcccctaaattgtgagaaggaatattggttgacataccaacagcaacaccaccagctccattaaccagtatattaggaaattctgctggtaatactacaggctctacttcattctcatcataattaggccgaaaatctacagtatcttcatctatgtcatttaataaaaaatgtgctgccttcgccaatctagcttctgtataacgcatagaagctggaggatcaccatctattgaaccaaaattaccctgactatcaattaacggcaatagcaaagaaaaatcctgcgccattcttactaatgaatcataaattgccgcatctgcatgaggatgatatttccccataacatcaccaacaacacgtgctgcttttttatacggcttaccataatcataaccagacttatacatagaatacaaaatccttctatgcacaggttttaatccatctcgtatatcaggaatcgccctactaactataacgctcattgcgtaagataagtaagaatcttctaattcttgttctatagaaaccggtatgacattattgacatcactcatctaatacttattaactaaccttaaaatatatcacacatcttaattcccaagcacatcaaggtcaagtaattgtttccaaaaacaaccaactaacattgctactaaaaacatcatataacccaaaatgagctgttcctcctgctatacaaccacaccaagtatttgtattgcacaaccattattacttcaacttaaaatttaaactaaaacagacaaaacatatttattattttgtgatgaggtctattctatattaaaagcgtaaccacattaaaaaacacaggtattacaaattaataatgtgtcattattgcataaaaatatctaaatttaattactactattttttaacaaatatacaccaatatactattgtcacgctatatttcatcacattaacaaaccgttctcaaaaatataatattaagatcttactttgactgtaccagaaaaaaaatataatatactccagataatgatgaatttattgcattatggaagattatataacttcacttaatgaagaccagagggaagctgtcattaatataaatggtcctattttaatattagccggagcaggtacaggtaaaactagaactattacttcaagaatagcatacatcattaataacaattttgcattacctagccaaattttagcagtaacatttactaataaagcagcaaacgaaatgctatctagaattagtgaattaacacctgtatataatatctggttaggaacttttcatgcaatagcagcaaaaatcttaagacagcatgctgaagtagttggattaaaaaacgattttacaatcattaacacagacgaccaactacaagtaataaaaaatattgtcaatgacatgcatcccgaatatgcatcagatgcccataaaattatcttaaataaaatacaaagatggaaagatagaggacttataccaagcaatattactgaaacagagttatataaacctattaatacagtagcattgagtacatatcacatttatcaagaaagattaaaatttttaaactgcgttgattttggagacttactactatacaacattcaaatattcactacacaacataatgtcttatcccattaccaagaacaatttaaatacataatggttgatgaatatcaggacataaatacaattcaatatttatggttaagattattagctcaaaaatacaaaaatctatgctgtgttggagatgatgaccaatcaatatatagttggcggggagcagaagtaggaaatattttaaaattttctgatgattttccaaatgcaaaaattgttcgattagaatgtaactacagatcaacatctaatatattagacgttgccacagcgataataaataacaataaatcaaggttaggaaaaaagctatggacaacaaacgagaaaggacaaaaagttaatttaatgaaattttgggatagtaaagcagaagcacagtatatatgtgaatatattaaaaatttacatgactaccaatttaacgagacagctattttagtaagggcaggatttcaaacaagaatattcgaggaatacttcattaaatatagcataccatataagataattggtggtacaagattctacgatagacaagaaattcgtgatatcatcgcctatttaaaaattacagttaaccctaataatgacatcgcttttgaaagaataattaataaacctaaacgacatataggagcatcaactcttaataaaatatacttatgtgctaaacaaaataatacatattttttgaacgcagcaaaaattctaatttcaaataatcaactacctgacaaagcatcccgatctttaaataacttattaaataagattgactcttggaaagaatctttatcatctgattcaatatcaaacactgttaaaatgatagcttacgactcaggatatgtagacatgttagaaaacgaaggtgaaaatggtttagcaagaatagaaaacataaaagaacttttttctgcattattaagttttaatgatgtaaatgaatttttagaacacatcagccttgtaacagaaacagactcattaaattacaatgacaactacacatatattatgacattacatgcagcaaaaggattagaattccctatagtttttctacctggatgggaagaaggagtatttccacatgaaaaatctttacaagacagaacaggagaagcactagaagaagagagaagactcgcctatgttgggattacacgagcacgtgaacaactatttatatcatgcgtagcagtaagagatattaacaactggcgccagcaaatgaaaatatcaagatttataaaggaattacctgcagaacatgtacaagttataaaaaatatttctagctattattaattattaagttttgtgaatcggttaatgctaataacagcattatgtaacagtatagaattctttaccatttcaacacatagggtatgatgtgcaacactaaccacatttttatacataatttataatcctttcgcgtcatttaatatatacacgataatacattcattaattgttaaagaattacatctatactacttacagtatttattataaagaatctccaatgctaaatcaattaagatccgcgatgcgcagattaactatgccatcatttatgcaatccttaaaaggcttcagtgttcagggtattagaaatacaaaatatactgaatgtacaagtggtgaacaagcctggaaggatatgtcaagaaacgacatatcaataaatggacagaatactaacattaatcaactaattgatcggtataacaaagagaatccacgaccacaaggcaatgaatatcgtacaatcttacattcaatgcttaattcgacgttttatcggtactctggacaaaagattaaccctgctcttcgtgacgaatgtataacaatgttaaatcaaacatctttgcatggttcactatatacacagataatgcatagtgctggaaaagatatacagcacagaatatatcctaataacagtattataccggccccacaatgttatgatactaaaatcaaagtaatttcaaactcaacattaaaggtacagtatcaggaaacaataaactttagagacatagcatcaggagatactgtatgcactgttaaggggaaactgtcattctatgtcagcgcaaatgaacacggtcacatattatataattctcctaaaatatcactgcaattaccagcacaaatatcatcagccctagttcctaggggcagggttttcatgagtaacatgttcactcctctaagtaatatagtaggtaggataaatgcattttttactaatactccttttcagaaaacaactccatacaagataacacgtggtaacgatatagctaggatagaatatagtttacaaaattacgcatgcttaccagtatcaatggaaatacaagatcaaaaagaagaaaatcaggagaagcagatacaacaacaagctcaacacgatatgtttgaggacattccactggacacagaagatcaaaaagaagaaaatcaggagcaacagacacaacaacaagctcaatacgatatatttgaggacattccactggatacagaagatcaaaaagaagaaaatcaggaggagcagatacaacaacaagctcaacacaatacatctcagaacatgcaagcagataatacaaattcaaaaaacagtaaacaaaatgtcagcaacaaaattactgtttccgcaattgtacatgcaccacaacaaaacaataatacacctacctcttctcgctctgtataacaatagttctctaatataaaatgtataatctcttctacactttcaaaatcctgacttcacttaaaacctacagataaatttactcctttatttgtcgcaaaaatcgaactaatccccaatacttctatcatgaaaaccgtgaaatacctataattcactcatcacaaaatagtaaaataaacatttatgttcatccacaagtacaaaactatataaaactatacccaagctaaaactccatatactccaaaaataataatacatattttattcaaaaacactcatcaaaataacaccaatatatctcattaccacttacattatataaaatatataaaatttaaataaaaagattaatttattataaataatatgctaaagtaaacgtaaatatacatagtgtggcatatgaacaataccattttaacaatcataatcatcatagcattaataatactgatgattgttcttctatcatttatcttttgcgctattaataacagatctcacaaggtattctttgataaacaattacccaacatatctagagattttatacaaacaatattttacccagaaaataacaaccaactaaacataacaaatctatcgcacaaaattcttagcaaccaattagcggttagtatgcctaatcttgacgaaaatttatttaaacagttacctagaatattaaaattttaccaatcacaagatacatccaatacatacattaaccaacattttcaatatatagtacaatcgttaggtataaaaacgaactataacaaccttaaaacatatcatcctaaaattgctttagctgcaaccttagataatatgtttacagtcctaaataactcagaaattagcccagatataatacatgaaattgtcaatcatttccatcaagaggtatatgaacaagcaggaattaaaatattaaataacatttttaatacagataaaaaccctactaatattattaaacctgtaaaccatattatacaatttgcagtatataactataatctaataactataagcataattagcaatatgtcattattcgacactgcaaagcctaataaggtacattcttttagtagcgttttccatttcaatatgttattaagaaaaaacccacgaacaaacagaagctctatatcatataatcaaacaacctttactttattcattcctaatagtattaaacattacattacaaaagaaaagtgtaacacacaatgtatgcaaccttcttctataacacaagatcctgattgtgccacattacattattacaacacaagtaattctcatacttctaccttagaatatcgcttaccaaacccaaaagccaaaccattatttcaaaacagaagagataatatacagatctaatagatattactacaaattaaacattctaataaaaaaggaaccaataaaaagtgctataaaacacatatgtatacttatacaccaatattaaaattagttaaaacataatacataaaatgataacactctcacaactataacagctatattagatacagaaacaactatttaatattcattaacaatacaatataaactactaaatttagtactgtattaattactttaaataaacccatataaatattacggaatattaaaaagaaaagtaaacctatattaatcaatttcctggaaaattagtaagaatattatgaattaatatattcactttttttaatctattagttaattaaataatctttaaaaataatatttgtaaactatccttgtaaaatatttaatattgtaatataatttaacaataaattttattaataatttaaatattagtctagtatataaaaaacttaggtataaaaacatgagtcacaatttttcaatagaaattgctgtaatagcattattgtctgtaatgttaatcatatttctagcagttgctacgttttactacctacgcaacaagcaatcaacattgttcaaaaaatatatacccatgtcagaagaaacaatgaagcaatcaatttttgcacttcctattcaaaaccgaccaaatagtgccgctacacagggtaaaacatcacacctagatttccatcgtattcagtatactatcaatggtatgaaagtccatgctgcaacattttttacccaatataatacattagaatcaaccataaagtccggaaatatgacatctgactgtaatgttattaggctagcaaacaaacataaagaagccataaaacaagcattagatatagatgataaaacatgtcgcgacatgttttaccacaggatagcaatggccacaatttttgaattaattttcgacacaaacactggagtggttcccaacataaatataacacatgaaatagtaagccattgtaatcaagcaggaaatttcgctatgccagcaatgttctttgaaaaaattttaaaaacatgtaaagaatttaatattactaaaacaaagattaaagatctaaaggcatcacttacaatagaaaacagtaatgaaataacatgtactattagcacacacactaaaatatacaagcataaccaaactcagggatacgttttaccattcaaattaacatttacgatgatgccagaaaatagtcacagcttttcagatatgttatacaaaaacattactttagaagtaacagtacctgacacaatacaaaagtatattacaaacaacactactagtagtaaaattgagagtaacagaatcacattaactaatatgtgcagaaattcagaaggtaatacacaccttacatattctttaccaaatttaaaaattccttcattaattaataaatcaagtttcggtgctatagtaaagcataactatgaatctgttgaaagttgctcaccagtagtacagcatcaaacacatcattaaacacttgtattcaaatttccaaagtagcctgtacttttttacacaatacaagttttctactacataattataattgaatttacatttgctatattaattataaagaattattattgttttttttcattattttaatatacttaaatattatagttaaatgattaatgttttataactctaagaaatactatagaagtacaatattatggactaccttagtagcatagcaataactttaatattattaattatagtttttatagtaatactaattatagcacttcgtatttttaaagatagtaaaattgacacaatagaaatttttcaacagcacttgacttctatgtcacaagaaaatgtattacaagttatgttccctactaccaagcaaacaataaatactgacatcattaattgtaacgcatttcttactgatatctgccgcactgatatcactattcagaataccaaaattaaccgcgatagaataaaaaatatactttcaggttacattaacacacaacaaagtactaaattaacagataaacattcatcatacttatcaaatataagtaatacaaatcttcgtaatagaactcttgcagctgcaattttagaacaaatgtgctcaaatgtaaaacctaatatagtaataaaagaaagcattatacacgagttaatcagctgtttacatcaaggatgttttttcagcatttcgtacaaaataatcaatagcatttttaataaaggttcagaagaagatccaaactatattgtacgaggcagaaacactaacacatcaattaaaataaaaaacagtcatataataatttgtgacattaaaaatgatatacttataaatgataaaggtaatgttgatacagcaaaatatatacttacaagcaaactaactttttcaatatcatcaaatccaaagaacagttacagtcctatttcatacaaagatataaaattaacattacactttcctaaaaacatgagacaatacatcacaagtgaaaaaccagtaaggaacgtacaagaaaatttacctcatgctgtcttagtaaaaaaaagcaggaacacattagtatatcaactaccaagctttacatctaacagcatactactagaatattacaacaaacttctacaaaatgcagagagtatacaaccactagaacatttacatcattaacacacagacattcttataacatacaacagccaactaacaaacaaagcagcaactgttacatcagtaatcaaaatgtacattcaacaataccctacataacattgttatcagttctgacaaaaatcaatagcaccttatcaccaacaaatacacattaatatgtacatattttctataattagataactaataaaaatgcagagatcatacaaacaacaaaaacatttacatcattaacacacaaacatttttataacatataacagccaactaacaaacaaagcagcaactgttacatcagtaatcaaaatgtacattcaacaataccctacataacattgttatcagttctgacaaaaatcaatagcaccttatcaccaacaaatacacattaatatgtacatattttctataattagataactaataaaaatgcagagatcatacaaacaacaaaaacatttacatcattaacacacaaacatttttataacatataacagccaactaataaacaaagcagcaactgttagtacatcagtaatcaaagtgtacattcaacaataccctacataacattgttatcagttctgacaaaaatcaatagcatttatatcaccaagaaatacacattaatatgtacatattttctataattagataactaataaaaatgcagagagtatacacaaacaacaaaaatatttacatcataacacacagacatttttataacatataacagccaactaataaacaaagcagtaactgttagtacatcagtaatcaaagtgtacattcaacaataccctacataacattgttatcagttctgacaaaaatcaatagcatttatatcaccaagaaatacacattaatatgtacatattttctataattagataattaataaaaatgattaaacttattaagatatatagaaacatcaaggttatttacactacatctataaactgcaacattttcaaaaaaagaagacatagttactacttaataatttattccacagtatctaacaaaatcattccaaacactaaaatacatacttgaaataatgagttacaaccaatacaaaatatcaatgcagtttttttattaataatgttaagagaaacatttagcacaacatatatttttcacatgttgtgtaatcacattaccatcactaaaatcacctatacacaccttacatagtgacaccgtaatactttataaagataaaattagcaatattataataacatttataattaatactgcaattttaataacactaaacaataatatatgttattttttaatcaattaatacaatcttctatagggtattcttctgattatctatacttaacaccaaataacccaccagctatcagacgatacaacaatatagaatttcttcaaataaaaagtttgtctacacaagagatagaagaaattataaaatcaatattaaaagcagaagagtatcaaaaatgcatgacacaaggattttctaatactacacttgcttttgatgattcttaccaattacatatacatattttatatactgctacccagtcttttaaaattatagttaatattatacaaaatgaactcatagtaacaccagagtttgaaaaagaattacacagaataattagtatatgttcaaaaggattactattatttactggaaacatatgtaatgacaacaccgcattatttatattgaatcaaattaatgataaccaaaaaaagcacgtactaatcttcagtaatgatacaatacctgtcccaaaatccaacaaagcattaattagtatacacaatttaccacaagctgaacctacatttattaaaaaccaagcagcagatattgtatgtttcagtaattttaataatgctaatttagtacgcacagccattacatgtatcaatatgggtctactcgttatagcatttactgacacaatttcatgcttatgcgcactagaaaatattgcaatattatttccacacaaaaaatctattttaaaaatactatcaacacatttaatagctataataacacaagtctttattagagtatcgtctgataacttatatttatatgacataatagaatgcgataccacagtacaacaatacattagagaagataatttatcagaaatcaaaaacttaggtatgattaaaaaaataaaccagcttatagaaaaacatcaagtacattaccatgatgtagcaaatatattaaaaaacctatcagatactaaccaaccatacactgagcctaatcacaatgatcttttttaatcactattgaacatctaagtctaaaattctatactaataactctcaaagtaatattcatatttaattattatatcagtagatatcaatcaggattcatcaatacaatagaatctaattttaatgacaaggcagcgtcattcacatgcaataccaaatacctatacatataagtttgtagtgatacagtaataagtatataaatattttacaacagcacctaaaacaactcttattttataaattattacatatttcatgtatcaaatttacatgttacaatgctaaaaaatactttaataaacaatgcttaatgactttaaaatagacccactagttaaaaataaatcaccctcagcaacaactgcagttgttgctatgtccggcggtgttgatagttcagtagcagcagcattgttacacaaattagggtacaaagttatcggcatcactctacaactatataataatactactggaaaaggtgcatgctgtggtagtctggatacgcaagatgcaaaacaagtagcatcaattatggggttccctcattatactctcaactatgaaaaagtatttaaagaagaagtcatagatgattttatagacacatacatgcagggcaaaactcctataccatgtataaaatgcaatcaagttgtaaaatttagagatctacttaatgcaacaaaatcacttgatgcagatatcctagttaccggtcattatattagaaaaatagaacaagatgatgatatatacgtatattcaagcaaagatacaaaaaaagatcagagttattttctatttgcaactacaatagaacagctaaaatttcttagattcccactaggaaattttcataaagataacataagaaaattagcagaacattttaatctaccaatagcgaataaaccagatagccaaaatatatgtttcgttgcagatacatataaaaatacaatagcacaactaagacctaacgcaataaaaaaaggtaatattatagatactagtggaaacatattgggacaacatgatggtatagtcaattttactattggacaaagaagaggtataggattatcttcaaaggaaccattatatgttatcaaattaaatccagatactaatgaagttacagtgggccacaaatctgcactattgcaaaataagctacacatagaaaaaataaattggttagttaaggacaaaattccacacactggactaaatgttaaagtaaaactaagatcatcccattcaggtagcacagctatagtttatccaaacgataacaataaagcaactgtactattacaagacacatattgcacagtaactcctggacaagcatgtgttatttatgacggagatagaatgttaggaggaggatggatatgttaaacccatcttaattattcctgttaatccggatccaatttgtgatactagttttattcttcgactttctccttcagataatgttcctgattcacgatcgagtgttaaataacctaatttaacattttttaaacatgttagtcttttattgaacttttacaatattttttaatatttactagaaaatcacaaactgaaattttacaattattattaaactagggtttgataacattataataacactaattcattaggatacgaaatcaaaactttattttaataaaaacgttatcaataactatatccacctatatttacaaaactattacattctataaagatacacacaataacgaacgctacacctatttaaaatagtaatcttacataaagtacaatgttttcaaacatcgaaatttcaacctattgttttatagatatttgaccactcctcttgtgaatattggcataggtttttgtattattgacactttaaattaagacgacaacactgcaaacgataatacatcaagtcaacacaaaacgatattaatatccactgtatacttgtgacactcctagtaaaataataccatactagataaatgaaacgtacacttactttttgtagaagatgaatcatcacataactttagaaagacagatagcagctttgcatgccttttttataaaaaaagacaagatactatagttagcagcattaccagaattataacacatagcagtatcatgatgttccagctcttcattacgaaactgaataaccttatcttttaattcaccttcatccaacattgctatttgatcttgataatgatcacttattacatcttccacagcaacagtacaagccatagctgcatcctcacccattaaagccgttgtaatacctaacataactcccataacatgccatactggtaaaaaaactgtaggacgtatttttttatctttcattacagaatcaaaataacgaaaatgcttctgttcttgtttcttcatttcaagaattttctcaccaacagacattttacgaaaaatcaattcttgaccagaatatatacacactgctccatactctccagcatgatttactcgaatagcttgttgcaatagattatctttttgtaacatattgttttacaaataaatagacacttaatactaaacatagcacacaatatataagattgcattctgccatagataatcctataaatacaatactaggacgattacaagatattaccacatttacatctagtaaagcatttttcaggtcatcaaaatttaaagattttatactatctgtacatcctataatatccgctacccaactatgttcaagagcaacatgataacctgagatgcatatattgcatatataacataagcacattataaaaaaaattactttagatgatttaaataaatataagataaacaatccaacagtaataaaatatggtatgcgttcatatatacataacttacaaggaagcattccaaacaaatattgagctatataggctacacccaatgcaacaatacttgctataaataacaaaattacactgtaattttttaccatcttcatcactttacctgaattttagcaaagtaaaaatataactattaagagccactgcatcacgaatagttaagtcaaaacatataaatgctacaagatacataactatcaatgtataaatgactaacactagtccttcaaaaactattgaaaagcaattgttatataatatctgcaaactagagataggccaaggttttattatgtcaagaatattaaaaaacacaaaagggatcaaaaagaacattaaaaaatgcataaaatcattaaaccaagaaggacacataaaaatattttgacatattttactataaaatattgccaagtagttatatattgcaagtattgcaggcatagacaatgcaactactaaaagctgtcctaatgctatttgtactactattatatcacttctatcatcagcagagttattagattgaaatacaaaaattgatataatagatattacaatcagccctaacgatatctttaaaaataatgatgctactacagctcctgttactaatataccatatgatacataggacattccgtatattaagtagaataatacataacccaatattaaagacaagaccgcagcccaatgattctgccatgctggtaaatatccagtacctaaaaacgtgcttattaacctagtaggtaatattttacctataattttcattaaaatttgcaaccaagaaactaacatacgcctatactaattgaacattacaaaccagtaaaaaataaatcttactctttaacttataaaaagaaaatataaaatataaccaacactatctaaaacatacaaatcatattatgaagaacaaatagttacttgacttgttagcaatttgttactatgcttggtaggttattacttagttacattgttgtttatggctaaaaaaggttctactttacttgtaaaattagcaagcagtgcaaaaactggttttttttatgtaaagaagcgtaatcctaaaaaattaattaataagctctcttttcgaaagtatgatcctatagtaaaaaaacatgtattattcactgaggaaaagctaaggtaggtttgggcacacagcattcttctagagacataatacgagttaattttcttggttttggtatagtgggtttgtcgtctcctatgcttggtggtagtgtttgctcttcacattcaattgacggaagcgaagctgaaggtgtatgttcttcacatgtgtctatatattcgctagcagaatctgaactttccgaggggataatagtacatgcactgctctcttctatctttagaagctttccagattccgataatttaacacgcaacttagcacataaacagcagctgatacaaattatagataatatgaagacagcaatagcaataagacaaatgcttgtatatccatttttaccaattgcattaagtatctcatatataattttctcacattcaattatcgttgctataacaataaacgtaattagtacgaaaactgtcattaatgatacaaacaatttagcatatttactgttttctctatttacacctctttttttaacaatatgacaaacctcttttgtcattaaatttttattcattaatttcatgacatagctactgccatttctggaaactaaactttgtctactatctgcaagtagaagagccactatctctgcactaccagtttttatagcgatatctaatgctgtttccttatttgcattgacgctcattaaattaatgttataacaagacagtatctttttcactaaactaattctacgtgttgccacagcttgatgtaatagattattaccattagaatctatattctcaaaaattttttgcaatccatactcggtatatttaagtttattacgcaaaaccggtaacaatagttcagcacatgctatcttattatcctgaatggcaatatcaaaagctgttttaccttcacagttctcctgtaaaataacatcctgccaacctaaatacaaagctcttgacaataactctacattaccagcaataacacattgatgtaataagttattaccacgatgatctacagtagtaattggagtacatccgtcactatttacaactgataaattgatatcacaacacgataataaacaacttactattcctaatttcccttcttcaattgcaaggtgtataggagcacaactcctaccagtatttgtaagttcatcaatttcaccatcatcattaaacacagttgcttgaagattaacatccataccaagattaatacagagtagtaaattatctatactaccacccagagcagcatgatgcataatggttctacccatattatctctagcatgtatcgcaaatggatcatactgaatcaacaattttaacacatccaatgaatcattactacctgcagccaaatgtaatggtgttaatccagattttgcaggtttcggaataatctttgacctacttcctaacaaaaactttgcacatttttttgcattatatattgctgcaaaatgtagtactgtatagccatatgcattagtagcattaatgttaaatctatgttgacttaacacatccttcaataaatgtacactatctgattgtaccaatatagataaaatactatcatgatcgggaccaaaactcattcctagcatacgtctgtgatggattctcaacgcaccatctccagagtaatcttgatctgctctttttaattcttccaatccaattaagcatataaatttgactatgttttcatatgatcccttacataccctagacaataacttatcgttattgcgtataacacgagtaaaattctttaaattttctactagagatttatttttctcagcatttaaatcaaaaccttctgttttgaaacctagcaaacaattaacacattctaaaaatgcattagaaacaatatcttgttgttgtattactttaagcaatgcactctctgttactttttgtaatacatcatcatgttctttcaatttagtgaaagaatgatatataatattaattgcatgaacatcttcacattctaatgcatattgcagtgatgtcttcttgtaatctactacttgataatttatatttccatcactaaagcatgtgatcgcaaatttacttattctgctttcttgtttaccaaacgtactactaaaaattgacttaagaaatccttctttgtcaatagaatcatcaggaaatactaaacctaaactaccaagatcacatacgtaaagatgcccttctaaaacttctccttctatagcatgacaggaatatattgatttaatattctctacaatactataacatcctactttatcttgatatacaagaaactggcaattttgtttaatttttttcttttttccacactttaagaatgccaaaatctctgaaaaaaaagcagaaaaatttccttcccttgatgcatttgctaataatctgtttatgggaacaaggcgctcaggaggtataccctgagttctcatctgacttaatgctgtaatatcttcctcagataacacaatattgtcattaaaattatttgaatctaactgagttccatataatatcacaccatcattgccttggtgttgcatatcaccattattattaaacatattaactatctttatcacttgtttcgattaaagttctataagttaatactatgaaatatatattaacaattgtgctaaagcacaaatcatcaattttaaataatccaacaaattaatacttacttgtaattttcataaaaaatgtaaaagttattttataaaaaattaaaaaaatatgaaaatatcaatagatttataaaatattaatatagttaatttatttaatattattgacttatatattaggaagtattaatataacaatatattattttttttaataattattaactatataactacacaaatgaagaaacattatgatgaataacacacacaatacaaataacgttgtaaatcaagtgcaagacatagcacaagataaccatatttcagacaataatgccaacgaggctagagaagtactagctgctcatgctgcagaaaataacgctaatgaaattagagaagtattacatgactattctctagatgactacgctatagatgaccacaacataggcggtaatgctgaagcacaagatgactattctttagatgattatgctatagatgactacaatataggcggtaatgctgaagtacaagataaccatatttcagacaataataccaatgaggctagagaagtactacttgctcatgctgcagaaaataacgctaatgaaattagagaagtattatatgactattctctagatgattatgccatagatgaccacaatatagatggtaatgctgaagtacaagataaccatatttcagacaataataccaatgaggctagagaagtactacttgctcatgctgcagaaaataacgctaatgaaattagagaagtattatatgactattctctagatgattatgccatagatgaccacaacataggcggtaatgctgaagcacaagatgactattctttagatgattatgctatagatgactacaatataggcggtaatgctgaagcacaagataactattctttagatgattatgctatagatgactacaacataggcggtaatgctgaagtacaagataaccatatttcagacaataataccaatgagactagagaagcattagctgctcatgctgcagaaaataacgctaatgaaattagagaagtattgtataattattctctagatgactacgctatagatgaccacaacatagacggtaatgctgaagtacaagataaccatatttcagacaataataccaatgagactagagaagcactagctgctcatgctgcagaaaataacgctaatgaaattagagaagtattgtataattattctctagatgactacgctatagatgaccacaacatagacggtaatgctgaagtacaagataaccatatttcagacaataataccaatgaggctagagaggcacaagttaatgaagagttggataacgtaaatacaactgctaatacacaaaatatcaatgaacgattagaacattgtcacatttcgcagacaaatctacacaaacacacttttcaaaaataacattaaaaaatcaatatactaattatacaaacgtatagttagtatattgaaaccttgcaaaatagcagcattaatgtacttaataagtataaaatgactgtcaaaactcgcgatattgctctaagttaatatataaaaattacttcatttaacatagtagtctaaacaagttaatatcacatttgtatgaactaataagtttaatacactcggccattgattttaatcatcttatctgaaataacgtcgccagtattatacaaataaaaattaatcagcagtttcactgcaaaatatacttttacaaggaagtcaatctctataatcttccttaacagcaacttataaataataaatcactgatttatataattacatcaccatcagatcatcaagttatacaagaaattatagaaccccattactcatatgtacaataacctcgcacacatataataacctcatataatagtcaatcaaacactacaaattctgcacatttttcaatataacaaataaaatactcactatatattaaatactattttaaatcttaaaattacatcaatgaaaacaataagaactttttaagatattatacttattcgcactaaaaaataatgtttttaactattttatattgaaatataaataaatatattgaatttatttatatttcatgacaccctgtaaaaattacagcaccaagagttaccatgccatttgaagctattaaatacaataatttagaaacagttttaaaaaaaatattggagataccagaaataccacatcttaaccttctaccatacgaatcaagccaaaataagtcatatcaaactttcatagaagaaaacattgagaagttatcagattacaatcgctacaaaaatgctaccagagaacactatcaaatacaaatcatcaacacagaatgtttagtaaatttattattgctaaattttatcgaagaaaagattcgttgctgtataagaaagcaagaaaagtttcaactgttagtaataggagtaatagaaaccaaatgtttcaaattttataataaccaccttcatgatatattacatctcacaaaactacacttaaaaaacttagtatttttacaacttaacgcagaacctaaatggaaaatcaggacttgccattttacacgctacctaaacgcacaaaataacttaagaatactaattctcaacaacagaactaccaattgcctaaaagttagtaatcaaattaaacatgataaacctacattcaaattcacttccaaccaaatagagtatttatttttagaaaattatccactctccattataggctgcttccctaagcttaaattcttacaaatcataatacaaccatacacaacaacaacatacaaaataaaattgttcaaatattttcaccccaattttaacatgttagaacgtctagtgttagttaacgcaaaaattgaaaataatgaagctatatatcctagtcaaaagtaccacaacgtatcaacaatactctcattaacaaatatcaaagtacaaaaatacataagtaataaaaaacatcacataatgatatatggcaatagaaactcaagttatcaaccaccaaacgacactgcttatcaatttctatataacaataatgacagaactttacacttatctaatgaatttacaaaaatacttacaagaaataacatatataacacatataatataaacatttctattaaaggagagatttctcccaacactctcatggaacataataaaacaggtaacattgctttatcacctgacaaatcattaatacaatatatcaattacatatatgatcccagcactaaaaatctatcaaacgtaactaatataatagacacaccttatattataacaggacacaatattaaccagacagaatttgtcgactcttcatcaataaactttactcctgaattaataaaacatactgttgactgcagatataatcaacatagtactcaaattttagacaatggaaattctactagaactgatgacgatttattcacacaaatcattgatgacacatataatcaaaacagtattgaaagttcaaataatgaaagcaccattagtattgactcaccaatacaagttataaatgacatatatgactttaaaattgatgacgttttactaacacaaatcatagatgacatatatgatcaaaatagtcttcacaatttagataccaaggataataccaaaactgatgatgatttatcaatgcaagttactgatgacatacatgactttaaaactgatgataatctgctaatacaaattattaacgatatatacaaccaacacagtactcaaaattcaattcataatattagcactgatgatgatttactaatgcaactcatcgatgacacacatgctcaaaacagtattgagatcccaaataacgaaagtactaccaaaactaattcattaatagaaatcatagacagtatatataatcaacatagcacttcaaatgcagacaataacaatgatattacagatggtaatgattcactaacccaaatcacagatgacatatatgatcaaaatagtcttcacaatttagataccaaggataataccaaaactgatgatgatttatcaatgcaagttactgatgacatacatgactttaaaactgatgataatctgctaatacaaattattaacgatatatacaaccaacacagtactcaaaattcaattcataatattagcactgatgatgatttattaatgcaaatcatcgatgacacacatgctcaaaacagtattgagatcccaaataacgaaagcactaccaaaactaactcattaatagaaatcatagacagtatatataatcaacatagcactccaaatgcagacaataacaatgatattacagatggtaatgattcactaacccaaatcacagatgacatatacgattttggaactgatgatgatttactaatgcaagttactgatgacatacatgatctacacactactcaaactttaggcaatgataaaaaaattaaaactaataatgatctatttgtaactaacattcaatcttatagaccggcaaaaagtttaaatatacagaacatttaactaagcacaaataaacacaatgtagataatagtaaaaactagaaagtaaataatgtaaaagcaagtatcacatcattaactacaattagtctaagaccattttaatcataatgatacaccaatagataaaattacaagttttcagacgttccattgctcattagggttatgacttttaattacagtcttatattaaaaacataacattcagtacacaaaaaataataacatttcttatgtttagaataaaacagtgatcaaaaaaacttacaaatattctttatttaacatattaagcacttgacaagtgtaacatatatactaagacatgtatcataaaatatcaaattaacagcataataattagaaattaaataagttgattcttgtagtcgtatgttatatattacgtagcgataggtatggtttttgtttcaattaataaaccactacagaaatcttaccctactaagcttttaatgattattgtaaatttaatattgcgtatgttaaggttgtgtttacggcattcgttttttgcaagcttattatttaatgatgtgtataatttcaatttttaatggataaattatggaaagtaatgacgaaaagttagaatctgtcaaagatactgtgactaaaattgtgattgattgtttaaaactaaaagacgaacaaaaagctactctatccggtagcactaatttagcaaaagacttgaatcttgatagccttgatttcgtagatttggtaatgtgcttagaagaccatttctccatagaaatttccgatgaagaagcacaagaacttgaaactatagataaaatagaagagtatatacgtaataagttatcaagtaagaattgattggagtagcttatatggcaaaaaagagagttgttattaccgggctagggttagtcacttctctaggtagcgatttaaaaacagtatgggactctttatctaaaggaatttcaggtataagaaaaattgatagatttgatacatctgaccttgactgtaaagtagctggtcaggtaacaacaaaacctgaatctgaagaatatatttttgatgccggagattatataccagaaaaagatttaaaaaaaatggatacttttattcattttggtatagcatctgctacccaagcaattaatgactctaatttacttgattataaagatcttgactatagtagagtaggagtaatagtgggatcaggaataggtggtctccaatttatcgaaaaaactgttatatgtttgaaagagcgtggtccgaagagaattagtcccttttttattcctgcaagtttaattaatttaacatctggtcacatatccatgaagtatgggttcacaggattaaatgatgcagtagtaaccgcatgttcaacaggagcacaagctataggtaatgcagcaagagtcattcaatctggtgaagcagatgtaataatagctggtggaacagaaagtgcaatctgccgtataggaattgcaggatttgcagctatgaaagcactctcaacaaaatttaatgatactccagagttagcatcacgtccctgggataagcaaagagacggatttgttatgggagaaggttcaggagtagttatattagaagactacgaacatgctaaaaaacgtggagcaagaatatacggggaactgttagggtatggcatgacctcagatgcatatcatatgtcagcacctcatccagaagggaaaggtggaataaaatctattgagctcgcactatctaacgcacaattaaacccagaatctataaattacataaatgcacatggtacttccactcctataggagatagtatagaaatccaagcaataaagaatgtatttaaggaaagcgtatataaagtaccaatatcatcaacaaaatcctccataggccatttacttggagcagcaggaagcgttgaagctatattctgtatacttgctatgaatacaggaattgcccctcctacattaaatttacatgagtcttctgaagatccaaaattaaatcttgttccacttaatgcacaggaacataagatcaattattgtctttctaactcttttgggtttggtggagtaaatgtatctttagtatttggtaaggtgtagagttattttggttacatatcttagtatataatcttcacatattttgttctgtaatactagttaaaacattatcgtctacttttactaatatgataatttatacttaaacattatacattatagttgccttctatccttgtataaacaaaagcacagggattttaatatttctactacacaagtgtattaataaatatctcagattcataaaaaacgtgcagtaggtaacactaatttcaatagagttcttaacaataaatactatttattattactaattatttgattaatataagttaatatcttaacttatattattagatacaaaaaaagttaattatgaaaatcaataaagaattatcccaccaagaactgatatcatgtcttagagtaataagaacaccaaacataggtccatcaacatttcatgcattaattaagctatataaaacttgtcaacatatactggaagttctaccaaacttaataaaaaaatctaaaattaataataaaattcacaacatatgctctattgaagcagcagaactagaaattgaaaatactactaagattggtggaaaaataattactgtatttgatgaagactacccagaaattttacgtaatattcacgattatccaccagttataacagtactaggagactcatcactgttaaaagaaaaaacaataggaatagtaggaagcaggaacccttccatcaatggaaaaaattttgcttataagttatcatacgaattagctaactctggttttgttatagcgtccggattagcaagaggaatagataaatctgcacatagtataatttaccaacaattaccaacaattgctgtcatggccagcggagtcaacatagtatacccgcaggaaaatatacatttatataacaccatagtagataaaggaggattaataatcacggaatttcctttttctacattaccaagggctcaattatttccacaacgtaatcgtataatttctggattatcacttggagtagtaattgtcgaagcatctatacaatcaggatcacttattacagcaaatttcgctttagaacaaaatagagaagtatttgcagttcctgggtcaccacttgaccataggtgtagaggaagtaacagtctaataaaaaacggagcaaaattagtagaatttacacacgatatcacagaaagtttacaatttaacaataataaaccttacatacaacaatcaatattcgataatacaacaaaaagtgataataacctttttgaaatcaataatgcaaaagatactattctgcaatacataacccatagtccaaccgaaattgaagaaatcattgcgtctactaatttgaacatcagtagtatattaatagccttaattgagctagaagcagcacaaaaaatagaaagatttcctaacaataaagtagctttaatgcactactagacttaaaaattaatactttttataaaattatcttttagttaattaagtcacttcaataattagacaagaatagaaagattccataacaataaagtagctttaatgcactactagacttaaaaattaatactttttataaaattatcttttagttaattacgtcattgcaataattaggcaagaatagaaagattccataacaataaagtagctttaatgcactactagacttaaaaattaatattttttataaaattatctttcagttaattacgtcattgcaataattaggcaagaatagaaagattccataataataaagttttttggatatcataatctcttaaaatctaaaaatttttttataaaatacttttttaagcatttcacaataagtaagctactttaatataaatatagagacatacaaaaacacatattaatgtctacgaatatgtattcaccacacaaactttgaaaatcacacttaaaatcaacaaaactacatatactagatgacattaaatatgtagttttatattgtcaacatatccaaattatttcactatcttcttgaaaaaagcctatctatctcaactaaatttagctctacataagttggcctaccatgattacattgtccagaatgtgcagtattttccatattccttaaaatagcattcatttcttcaatctttaattttctaccacttctaatagaactataacatgctatagtcccacatatatccttaatcttatcatctaagaataaagtatcacctacttccataatactatcaactatattaataataagcgatttaacatcaaaacttccaaaaagtgctggaacttcccttactattaccgataaattaccaagtggttcaatgagtaatccaagttttaataacttttccttatattcaacaagtaactccaaatcaagatggttattcatttcaataatctcaggtatcaatagtatctgacgctttatcccctcttttgccataacttgtttcatatattcataagttaatctctcatgagctgcatgctgatcaataataacaatagaatcctgtgtttgagagatgatatatctactgtgtatttgacataaagcatagcctaatggataagtatcaattaatgaatcacttggtacttttttactagtattaaacttaccactatctatactaggtgactcctgtagaagattattagctaaattaacaaaattttttttctctcctaatatatcaaaattactaacctctattttagaatctcccttattaatatgctctctagaattttcataaactctctcttcttttaatttattcgttatcatttttgaatctgtacaaaaggagacattagtatctaacaaagattggtcatctgtttctacatttttagaactatatttttgcacgtcattgttaagtaatggttttctattttgaaaacatttaaaaaactcggaagaaacgctattacctatgtttcttgaatttaccatactagcatgtacaaaatgatcattttcaaattcacttatagactttaatttagtatttaggttgatcgataacacttctttaattgcattaactacagttctatatactaactttttatcttgaaatcttacctcagatttattcggatgaacattagcgtcaacttgatcacatggaatatcaagatataatacaacaactggatatttatccttttctataaaatcactataagcatatctaactgcacctatcagtaaattatcataaacaggtcgactattaacaaaagtatatataagacttgacttaccacgacttaatgtaggagatccaatataacctgataattgaatctgctcttcttttacattcactggtaaagaatttttacaaaattccattcccaaagtttttatttcagataatctatcaatatttgattgttgtgttaaatatttaaatacctgtttattatcaacaaataatgaaaacattacattatgatttaccatagctagtttgttcatcatatcaataatagattgaacctctgctttttctgtcctaagaaactttaacctattaggtgtagcaaaaaacaaatctctcacttcaatataagtaccacaagaaagtgcatctggtgtcaattcttgtgttttttctccaccttcaaataccattaaccatgcagtatcagaatctctatattttgaaaccatttttacttttccaacagctgcaatagaagttaatccttctcctcgaaaccccaaggatctaacttttgttaaatcaccatcaggaagcttagacgttgcatgacgagcaaatgcaatttccatatcttctttttttattccaataccattatcactaacaattattaaattacgtcctccacgttctattgtaatacttatggcagtagctttagcatctattgaattttcaactaattctttaaccacactagctggacattctattacttcccctgcagcaattctattaattgttctaggatctaatagtataattgacatatgctaacactgataattgaaacaacatttatagacatacagaaataacaactatttcttagtagtacaaccactaaacatccagtataaattaccttaagtaatttactactataatttaataatgttttcaaaacatctataaacctaattttatcaattcaagctacttactacaattaaaaatagacttataaaacacatgcatactaataaataattcacccttttataaatagaaccacaaactattagaagcctttttcttcaagggtattagtatacgggaacattaaggttactatagtacctaaattaggttcactctttattttaaataccccatccatcagttcaactaatttcttacttaaaggtaaacctaaccctgtaccttcatatttacgagcatgtctactatctacctgcccaaaaacagacataaccttatacaaatcttgctgtgctatacctataccattatcaataacttcaataacaatcatgctattttcgagatcatattctaccactaattttacacatccattttcaggagtaaattttattgaattggataataagttgatgataacttgtttcattcttttaggatctgcaaccattataatttgattagatggtaatacttgttcaagtcttacttttgcttcctcagctcttggaagtatcatattaaagcaggaagaaataacttttcctaaatcaaattttacaaattctacaactaatttatcagcctcagccttagagaaatctaaaatatcattaattaagcttaatagatggacaccagcattgtgaatatcatttatatactccttataatgaacattctctatagcccccatggactcagccttcatcatttccgaaaacccaataatagagttcaatggagtacgtaactcatgactaacatttgcaagaaattgtgatttacttacattctcttgttctgctacttcctttgcttcttttaattttagatttgcgttatactgcttacttagcatttttgcatttttataatatatacaccaagttacaacaataaatataataatgactaatatgactatcattaaaaacacagtatagaaatttacaataaaactggataaattttctgaatttttaattatctttaaaaacattaaaggagaactatcttgaccatctaatgaaaatataggaaatatagacacagtagttgctccattacttactctatggtctacatattttcctcttaataatgaattcatatcttcagaacgtaacagcaggtcctgatctgcaatatcttcactacttctattagaaaatattacatttccatctacattatataaaataacatgaaaatctttaaccccacctaaagctttgagaaattcagcacgtaactttatcaacaaattcatatagtacgtatttgttgatacatgacttggagcctttgctaataattgagcatatttattgatcacagaattaacaagtattgctttaatattgacattgatttcttttgaaacttcatacagataatcatccctcaaatatatatgcgtataaccaactgcaaagcacaaagtcattactaaaaacattaacaataaaattcgaaaatatttcatatatatacccaatcacccatagcatgataatatgtatatggtgctatttataaactttttcttagttgacatataacaatatcgtgttacagttacacactattatattctatttacttagttctttaattttgaggaaatgttaaatgaatagttcgccaattttacctgtttatgcaccatctaaggttactttctcacatgggaaaggagtctatttatacgactataataataaaaaatatgtagattttcatgcaggcattgcaactagttcgttaggacacgctcatccagcattagtaaatgcattaaaaacacaaggtgaaaagttatggcacatatcaaatgtacatacaatacctgaagctatcaagttagcacaaaaattagtagatattagcttcgctgataaagtgttttttaataattcaggtgcagaatctgtagaatgttgcttaaagatagcaaggtcataccaatgtggtaaaggtaatactcaacgttatagattcattacaatgaagcagtcttatcatggaagaacatgtgctgcatgttcagcaaatgatccaagtaaattctctccatttcttaaaccatacgttgaatggtttgactgtgtaaatcctgatatcacatccataaaaaatgcaattaatgaaactataggtgctatactattagaacctatacaaggagaaggaggaatcaacgtacttgatgattctttcttgaaagaattacgtacaatttgtgatcaaaacgatatactgctaattttcgattgtgtacaatgtggaagtggaagaacaggaaaattctttgctcatgagcatactggagtaactcctgacatatgttgtcttgcaaaaggattaggtggtggtttccctatatcagcaactttagcaaccaataatgcttctcagtttatgggtgttggcatgcatggttctacttttggaggaaatcctttagcaactactattggaatgactgtagttgaagaaattttaaaagatgggtttttagacaatgtaactaaaaatggccattatctgtacaaaaggttggaagatttagctaaaaaatttccagtaattgaagaagtaaaaggtaaagggctcatgataggactaaaaatcaatactaatattaataatagagaattaatgcatgatttaataagttgtgggttactaaccaacactgcaagcaataatactttaaggatagtacctcctttaatcataactcaacaagaaattgatgaaggtcttgctatactagaaagttatctgcaaagcaaatatcatcagtaaataacaagctttactaatatcaaatatataaggtttacttacaggtattattgcattattttatcaatattcagtagtatcggctacataatataaagctacattactaatagtaatttaatatataggtattgttttagtacagatagtcttacagataaggtttttatatatagtcaatccataaaatttgttatctgttaacacaagtggttaaagctatactgtttaagtttgctatcattgagttttcattatttgctatagtagtagatggttttgtagtctattatattacaagaatgcaaaacagtaattattatacgataatatatagatattgttttagtacagatagtcttacagataaggtttttatatatagtcaatccataaaatttgttatttgttaacacaagtggttaaagctatactgtttaagtttactatcattgagtttccattatttgctatagtagtagatagttttgtagtctattatattacaagaatgcaaaacagtaattattatacgataatatatagatattgttttagtacaggtagtcttacagataaggttttttatacatagtcaatccataaatttgttatctgttagcacaagtgttaaagctatagtattaagtttgctatcaattggatttccattatttactatagtagtagatagttttgtagcctattacaagaatacaaaacaatagttattatacgataatttatcaactaataagtttatagtctaccatttgagtaacatagattttatagttatattataaatttgcacaatatctctaataatcatttcacaagaaatcagtaaagtggattactgttgttagaaaaccactcagaaagaaaatactgttactaaaaatcaacttgatgtttcataatttatatggtactattaaagcacacttttgtgttgtacaccactcagtggctatttcatctactttttaagttaacatggtacagggctatgatagtaggacaaaacaatcaagggggttcttgcgcaggatcagatgaatatcaaccactaaacacagatccacttccaaatgacgatacatcaacagtagaatataatgagttttcccctctattaaggtcagaagaagatgaaacaccagataaggcaaatgatgaaatactgaataagatagattttgatagatattttgtaattttttctttcattgggttattagcagaagcagcgtcttctatattcaatttagtatcaacccaagtttttattcctactagcactaaacatgcagtagctactgctttttatgctctctgtatactaattgcaatttccatgattgtaagttcaatacttgcaataaagaaatcactcaaccaaaaaaagcatcttgacgatatgccaacagatgcatcaaatgaagaatgtgtagaagagaacgccaaatataaaaaattaaaaaaaatacaggctcatgctcaagtttctgaaaatgctcttactatcatttcacaggtgatgtggcttattgtttatattgcatcactagtaatgatatctatgggtgacaaccaaatacttgaaaacatgagcctgtttttatcgattactgcatctcttttaggtattatatcttgtgttataaggttaatagatgcaaatatatcacgtaagacatctggttctgaggaagaaaaaaaacaacaccttagtttcacaattttttgcggtatcatcttagcttttgagataattcattgtgcatgccatatatcagaagcaatatctcttggtggaaaaatgcacaatctttatgactttcagaatattcctatactctgtttcgaactgataacagtagctatgtttattgcatcattcttcatagaacagtgcattaaaagtaaaggaggaaagcaccagaccaatgatgatggtgttgccgctgccgcttgttgcggtgataatctccatcctagtagcttattagctgatgatagtggtggtaatattgccagacttatagtagcacaagaactatcagcttaacgttcatctataatatgtggaacaataacgctaatttcatagcagtattaacatagtatagaaaatgtataaccgtacaaccaacttacaacttttaaacgctgatgtaatttttaataatctgatgttgccgcttgttgcagtaataataatcctcctagcagcgcattagctgatgatagtggtgatagtattgccagacttatagttaccacacagcacaaggacaatcagtttaacgtcatctatgatatgtggaacaataacgctaattccatagcagcattaacatagtatataaaatgtataactgtacaactaacttacaacttttaaatgctgatgtaattttttaataatctaaggtagtaataatcatcattgtttacatattcgatactattcaagcaatatttctcgctttccagcacttgcaactccaataacaccatctctttccatacgctctactaaatttgcagctctattatatcctattcttaattgtctctggatatagctaatagaagttcttcgatcccttattactatcgacactgcttgtttatacaattcatcatcccgttcaggaatattatcatctatacaataatcataatcttgttggatccgtgtaataccttctatataatctggagttccttgagacctcaaatattcaactatattctgtatttcatcatcgctaacaaaagctccatgcacacgtattattctaccaccagataccatatacagcatgtcacccataccaagtaactgctctgctccttgttcaccaaggatagttctactatctatcttcgatgttacggcaaagctaattcttgttgggaaatttgcttttactacccctgtgattatatcaacagaaggacgctgagttgccataattatatgaattccagcagcccttgccatctgagataatctttgtatcgaagattcaatttctttcccagctacaagcattaaatctgccatttcatctactatcactacaatgtaaggaaaaacactaggctctattgcaattctttcgaaaattgcctcccctgtctctttatcaaaccctgtctgtaatactttttctagagttctattctcatcaattgcttctttaattttatcattataactaacaatattacgtactccaatatcagacattaaccggtaacgattttccatttcacttactacccactttaaagcagcaatagcctttttggattcagtcactactggagttaacaaatgtggaatagaattatagactgacaattctagtactttaggatcaatcataatcattttgcattgatctggagttaaactgtagatcagagataaaatcatagtattaattgctacagattttccagaccctgtagtaccagcaataagaagatgcggcatttttactaaatcagcaataactacttccccatctataccctttcctaaagctatgggtaatttaagcctagaatccctatactgttcactttcaaataaatcacgtaacatcactatttccctatagtgatttggtagttctatacccataacatttcttccaggaataactgatatacgtgttgacaaagcactcattgaacgagcaatatcatcagacaatcctataacccttgatgatttagtaccagcagatggttcaaactcatataatgttactactggaccatacctaatattaactatgtttccatgtatagaaaaatccttaagtactttattaagcaaattgacaacattatcatctggatgaaactctcttttatctactggattaggttttgataaataatcaacactaggtaggacaaattctttatacttttttttttcttgaactacttgaggagttgcctgaggtctcttataaactactatctctttttcattactgtcatcaatataatcgtctttatcatcatatttatcatgacattcttcatcgtaattactttcctcatcttcttcttcacattcatcatcatcttcttcaacttgaaattctaacccttcttcttcatctggaaaatctaattcttctgctaattcctctccttccacctcctcttccataaactcttctattgattcttcctcttctatttcttcttctattaactctttcgttaattcgtcttcctctatttcctcttcttcctctgtaaattctctctcatccaatgaatcttctatattataatactcttgagcttgtcctacattttgagagatttcttctcttataacagtatcactaatattgttagatttatgaattatcctactaaacatttttaataagatatcataaagatatacaatttttttccaaccaataattccagcagtacccaacaatactatagcaagcaatacaataattggacagctttgaaaatagatacctagaacaccaccataatagtatttatggatgacctttagagaaacattcgataccaatccacttattccaaccataatcatcaaactgctaccaaggtacaggtaaatattcctattgacacgacatagtatattaacaacgcaaaagaccattaaaggaattgctataaggctagatataccaaatatttgtacaaaaatatcagctagatgcgacccaacaacgccacctaaatttctcacaggagagtcagtcgccagattgaaagataaatcattttcatgataagtaagaattgacaaagaaacaaatgctaccacaaaagatagtaaaaatatcttaaaggaaacaaaagttttattaaggacagattttatactcacaactatcttacccaaaatagtaacgcaaagcatatcttataaaattaataaatatcaacaatacaagtggtgaaagatcaaaattataggaaatagtaaaaggcagaatcttcctgataaaattcaaggcaggagacatcaatttagataacaataaaaaaacattattaacaatctcattatacctatttacaatattcaatactattaaccagcttaatattatccatagcatcaaagagaaattataaatacttaacaatgtatcaagtaaatacaccaaaggatgcataaagtaatagctctctaattaacataaatattaaatgtttagtgtatagtacactaaaatcatagtcaatcacaaagagaaaaattcaacttgaaaaactcaagagtattatttatgatgtaaagtttactttaatgtttgatcctcaatgggtttattagtaacttcagtatttagtatacttatactactaattttatctgcatttttttctgctgcagaaacaagtataacttcaattagtagttcacttatccataaattaatgctacagggtaataaaagagcccaaatcattaacacactcagtcaaaagaaaaagcttgttataaatactgtattaataggcaatactattataaacatcactgcttcttctattgcaacagcaatttctattgaaattttaggaccacaggggatattattttcaaccgtcattatgacattgtttatactgatattttctgaagcattaccaaaaagctatgcaatactcaatccagaaaaaattgctttaatgatatcgtgtcccttatcatgttgcgtactcattttatcccccataacactatcaatacaatatatgatagattgtattttaaaaattctagacatgcataaagataaagaaatcatttcagcagcagaagctatgagaaatttaatctcactacatgatagtaaaggaaccatgctaaaacaagatttagacatgttgagtagcatattagatttagcagaaacagaaatttcacaagtaatgacccacaggaaaaacatattagcttttaatatagatacaaatataaatgatctaataaaaaaaatattagcaagctctcatagtagaataccattatggaaaaatcaagaagatcaaatcgtaggagtagtacatgttaaagatgtaataacgctaatacgggaaaaaggcaaaaatattactcaagaagatcttcataaagtaatgacaaaaccatggtttgttccagatacaactctgttgagtgttcagcttcataacttcttaaaaaatagaagacatcttgctttagtaatagatgagtacggagcattacaaggaatagtaacattagaagatgttattgaagaaatagttggagatattacagatgaacatgatattacaacagaagctccaataaaacaaatttgcgaaaatatatatcatattaatggttctacttccattagagatattaataggcagttacgttggaacttacctgatgaagaagcatcaacattggcaggagcaattgtgtatgaagttgaacgtatacctgaagaaggcgaggaatttttactatacggattgtcatttaaaatattaaagaaaagtggtcataccatttctagtattcaagttgatacatctccaaaagatacatctactataaaacacaagacagaacaacaaacttaaccgagtacacgttcaataataagaccgttataaccaaattacttataactgcgagctagatttggcatttttgtataaactcatgtaccactttatcaggatattcactatttaacacagcagatataacagctatgccgtcaacaccagttccaattactgaatccacatttgacaaattaatgccaccaatagccacaattttataaggtaaattcttaacccaataattaagtaaatctgtaccctgtggcataaaattcatgttttttaatgtagtaggaaaaatagggccaaaagcaatatatgaaggacgtatatatttcgctattgctaattcatgataacaatgggtactaatacctagtctcaatcctgcattatatatttcattaaagtttgcactcctcaagtcctcctgtcctaaatgcactccataagctttatactttactgcaaactgccaataatcattcacaaacaattttacaccattttgatttgcaatatgtacaccttcctttattttatactctacttcttctattggttcatttttaattctcagctgtactactttaacccctaaattaattacatacttcaaccaaaatagatctggcactatttggtaaaaacctacaggatcaagcataggatgaaaatttttatcaaaataataatctttattaagcgtaataatagggaaatacctttcatctaaaaaactagcatcttcaacagattgattagcagaagctcttgctataattaaagcatccttttgcaagtcagcagcatttaaacacttacttactaacacagatgctttatatgcagacaagaaattttctttaccattacatgacactccgttatataaaaaccataagccttccataccattaaagtaatagtcccaacatctgccatatttctgacttgcaacattaataacatatatgctctttttttttatagagtatagagagttgacacttctaacaatatcatcaagatcttctaattgagtagtacaacagtattgtattaaatctcttttatctacaatgcagacttcactaaaatcattttcagacataaaattcaaaagctataatatcaaatccacattaggatataatgaaaaattacataaaatcactaaaaacacaatatacgacataacatattttaaagaattactgaattcataacttgctaaaacgcatattttaaccataacaataaattagataaacttgattatatccaaaatagagaatcactacacaataaatacatattagcttattgttacacattctatccctactaaaatcaacattattgtactaaaaacatatatctcactacaaaatcactaaaacacaacttgcattaatactccataagttaaattagatattccacaggcagataacaaacaatatacctctattattaaggttgcattttattaaaatactgaataattgttgctgatatttcttcaacaaacttttgtgtaacatctataataggccagccatttcgtgaacacatatcttttttgttctttaatttcaccaatacatgctcgtaatcaatatactgaataagttaaattagatattccacaggcagatcatgaacaatgtacctctattattaaggttgcattttattaaaatactgaataattgttgctgatatttcttcaacaaacttttgtgtaacatctataataggccagccattttgaacacatatcctttttgtttctttaattccatcaatacatgctcgtaatcaacacactgaataagttaaattagatattccacaggcagatcatgaacaatgtacctctattattaatgttgcatcttattaaaatactgaataattgtcgctgctatttcttcaacagacttttgtgtaacatctataataggccagccattttgaacacatatcctttttgtttctttaatttccatcaatacatgctcgtaatcaacatactgataattattttgattcttcatagaaactaacctagtcctccttatctctattaatcggtcaatatcaatagttaaaccaacaataagcttatttttcatatttgataagtccacagataaattaatagagtgtactaatggtatatttactaccctatatccacgataagctaagtatatactggtaggagattttgaagtcctagaaacacctaaaataattatatcagcttggtctatatcccaaagattttgcccatcatcatgtgcaatggtataattaattgcatctatacgtgtaaaatactcatcatctaatccaatgttagtactaatatatggatctttcttaatatgcaaataacaagaaatttccctaataacatgtgacaatacaggaatacatggtatttcttgtgcaccagctttctgctttaaatatcttcttaattcatcatcaaacatcgtatacataataaaattatatttatccttttcaattaatgacattattttatctatctgctcattattattaataaacgaccagacaaattcattaacctctacagatctaaaatgctctagtgcagacctggctactgatgcaacagtctcgcatgtagaatcagaaattaagtgcagatttaaagtaacagaagtgctcatataaaatagattactaatacaatataaaaattgacaaccactcccaaaaaaatttattcttatttagtatacatacataaaaggaataaaagtaagtaattttaaatataaatttcttataaaaatcctggttcataactcacataatacattttaatattaaaatcattattgatatagactagtttcaatacccaaaattaacagaacatagccacacacataaaaatttaatactaacatttacattaacaacaactatataatttactattaaccttataagaagaactataaataaattttagtgatatctaagaactcagacaaatatcaatcaactgcattttctttctaaacgaacctacacaacttactatcttatatttagtcacctatctaactatacatatctttcaatacggaacataggaaagcaacatctaactatagcaaacttacttaaacaaaaacttatatttttacattttccttacagttaaaacataatacatgtcctcgagttatcgatttcatttcttctggagtcacacaaacatcacatgatacacatttcacatgagcaggaactaatttattatcaactgcaattctatcatcaaaagtaaaacaatcaccttcccaaagactatttttattttgagtactcttaaaatactctaatattcctccttttaaatgatataccttactgaaacctaaatctttcataaaagcagtagatttttcacatctaataccacctgtacaatacatagctataatagggtcttgatctactttattagatgcccaagaaatagcccattctggaaaatcacggaaacactttgtctgaggatttattgcattcttaaactttccaaaatttatctcataagtatttctagtatctatagtataaacatcagatctagaaattaaatcatcccaatcctgcggacttacatattccccacaaacagaattatcaaaatcttcaatacctagacatactaactcctttcttaacttgactttcattttggagaaaggattatgcatagcaaaacttttatgatatcgaatatcttttaacctatcatctagattcaaaaaagagaaaaactcatctaaagagctctgtttatcagctgctattgtagcattaattccctgttcagctaaaattatagtaccctttatactatgttgtacacaaaactcctttaatacaggttgaatatcataatagttagacaaatgtacaaaacgataaaaagttgaaactacgtaccccatattatgtttctctttaatcctccaacacactctaatatattttataaaggcaatactgtcaattaagcttaacaatcaaccatacatgtttactattatacattaaaaaaaataccacatggtatttgcatattctattaatagagaactattagtatataacataagtacctataatatatcttcgacaagtaaaatctctaagtctctattttatattaactaggatagatgtgttagtacagtatatcttactgcacaaatgcatttaataaatattattaatacatagctctaatgatttaacaactatttaattaatatttttaagaagaaaacacataaaacattatatttaacataccgtatcatatattaatacatacaaacccatatcaatagccaatcaagtaatagaactatttgaaatactataaccatgtataaaatcattaatgctacatggatttttcccttccaattgcactataagtggaattaaaacaccgtttttacatttaatatgcatatgagaattaatcactgtcccaggctttaaattttgcaaatcactatcaggacaataattagcctttaatattctgagtcttttatcattgaaaaataaaaaagctttaggatacaaagctctaatttttctacatataacctgagcttcctcattacagtctatatgaaaatctattattttattcgtatatgtagcatcattagcattttgtttaataggaaccaaatgatcaatattattaagcacttcaattaacattgaacttcctaagttagatagtttttggcttaaagtatcaatgttatcttgttcatctataggaatatccctttgcagcagaatatctccttcatcccatagctcattcatttgcataatggtaactccagtttgttcgtcacctgacagaattgcataatgtataggtgctgctccacgccatcttggcaacaaggatggatgtatatttatgcatccgtacttaggtatcgataacacagcctctggaataattaacccatatgcaactactacaatgacatctggatttaatgcaaaaattttttcttgctcataatcatgctttaaagattttggagtattgacctctatattattttgctctgcaataatatgtataggtgttttagtaagcacctttcctctccttccagcaggtttaggaagccttgtatacacagcaataacttcgtgatctttttcttctagaagagcacatagagccggtacagaaaattcgggagaacccataaatattattttcatagcaaaatacattcagttatatacagcctatttatattaaatatataaataaggcaagcttgtcccacctaatctttcacttgatacaaaaaaaaattatatacacaattgtaccaatcttcccactcataaaactacacatgtaacattaagagaaccataaagataaatttatactgtaactgctgttagatatacccaaatatacaatttgtaagaaatgacactaattatcaacatctcactattgaaggataatacagtacatatttagaatatttttaaaagaaatttacaagtagggctggtaggacttgaacctacggccatatcgttatgagcgatccgctccaaccaactgagctacagccccataattattaaatacagacaatgtatcttgtatcatatacaacagtaatttacaataaaaaattaacgctgtaacactttaaaactattactaaaaatattattaagcaatcctaacatacttaactgttataccatcaagaataaaacaatttaaatataccttatcagactatacactatttatacctacacaaacatagtaaactaagtaaatttactaattgtagttttataatatatccacaacactttccacattaaatacttataaacttaacttacaaagccacctactattataaacagcaattcaagttttaatcagatttcaatattctcaattataatagctatttctatactaaacataattatagtttgttgaacgaaaaattactatgtcgaaactatatggatttatattataccaattactttaatttataaaactatccaatactgcacaaacaatagcccacaaacctactaacagcacttgttaaaacgcatattttaactataacaataaattagataaataggtcattacacttataatagccattttctatactaaacaataattataatttgttgaacgaaaaaccactatgttgggccaatatggatttatattacaccaattactttaacttacaaaattatccaatactgcactaaacaacaacacacaaacctattaatagcaggtcattacattgaatatttcacatcgtatagaccacaaaaatatatgttgttgcctcaaattctcaactctatcattgtatgatatcactacttatcatttaacttataagttacttattacaatactaaaacgacaatcaaaatcaatattcataagcaaaatatacatgcactctaatgttgcactgcatctaaatcatcaatttcaaccatatcctgcgttacaatgtgatcttgctttacaatatcaacaatctgccgcgttaaggctgcactaattacttcatcaacattagatacaaaaactagttctaatccttccttaatattatctggaatctctacaatatctttttcatttctagatggtaatataacagttttgataccacttcttaatgcagctaataacttttcacgtaaaccaccaataggaagaactcttccccttaaagttacttcaccagtcatagcaacagtattctttactggaatattagtcatcaatgatacaatagaagtacacatagctatccctgctgatggaccatctttaggaacagcaccctcaggaacatgaacatgtatatcattttctaaaaacttcttaggatttattccaaaatttaagcatctagaacgtacataactatatgcagctttgacagattcctgcattatttcacctaacttaccagtatattttacttcacctttaccagacattaacaccgattctattgttaatatatcccctcctgaatcagtataggctaaccctgtaaccatacctactagatcttcttcttctattacaccgaaagaaaattttcgcacacctgcatacttttcgatattatccatatctacacagatactttttacttccttattaactaatatttcctttactgctttcctcataaggctagcaatctctctcttaaaacttcgtacaccactttctctagtatacatccttataagatgatatattgcattatcagaaatgctccattctttttcctgtaacccatgatctttatataactttggtattagatgcgttttagcaatttctaacttctcattctccgtatatccagatatattgattatctccatacggtcaattaacggcttacttaagtttaaagtatttgctgtcgcaataaacataacattcgaaagatcaaactctacctctatgtagtgatcaacaaaatgcttattatgctcaggatctaatacctcaagcaatgcagctgtaggatctcctcggaaatcagaacctattttatctatttcatctaaaaggaataagggattacatgtttttgctttcttcatttctttaataatcttacctggcatcgcccctacgtaagttctacgatgtccccttatttctgattcatcatgtattccccctaaagacatatgtataaaatttctacccgttgcctcagcaattgacctagcaagcgatgttttacccacaccaggaggtccaactaaacataatatagggcctttaggctttttaagacgctttaaaacagctaaaaattccaaaattctttcttttattttatccattccataatgattattatctaaaatttttatggaattactcatgttaatttttgaatttgaatatttaccccatggcaaatcaagaacccaatgaagatagctagatattatattagcttcaggagacataaaattcatctttttatatctctttaaatcggtcataagacgttctttagcttcatcagatagtggtgtagaatttattctcttctcaaattcgctagcagagtctatgtctacgctagaactatcactttcctctagttctttttgtatagcttttaactgctcatttaaataatacactttttgagtcgtttcaaactgagatttaacacggttacggattttcttttgaacatttaatacactaatttctagctttaagaagtcatatattttctctaatcttttagtcacattgaaagtttcaagaactatctgtttatctgaaatctttatacttagatgtgaagctataatatctgctaagtgacttaattctttcatatcataaattgatgctgcagcttctgcttgtatttttttgctcaatttattccaattatcaaattcacttaatactgatctttttaatgcctcaagtttatcatcaattactaaatctgtatcctcacgtacaacagatacatatgctttaaaaaacagattatcttcaataatttctagcgctttagctctactttctcctttgattaaaattttgacagcaccatcaggaagccttaacaattgaacaacctctgctactattcctactttatataaatcatcagcagtaggattatcaacagacccatcaatttgagttaataataaaattttacaattattatgctgagcagcatactctaaagcattaatagatctttctcttccaacaaataacggtattactacttgaggaaatactatagtatcacgtagcgtgagtactggtagtaaagttttatttttcatataatacctttaatgttttaaaaataagtgcgagcttaccatcaactcttcaaccatctccttactaattactacttgattcacatcagaacttccagggctttcaaacattaaatcaagtaataatgcttctaaaatagcccttaaacctctagcaccagttttcctgacagcagccttttttgcaattactgataatgcactatcatcaaactgaagattaatattatccatttcaaaaagtttcttgtattgtttaaccaaagaattttttggttcaactaaaatacgacataaagtactctcatcaagctcacctaaagatgtaataacaggaattctaccaacaaactccggaattaaaccaaacttcactaaatcttctggctcagtgtaacaaaaaatatctttattctttgatactttttgtacattcgcttcaaaccccatactactacctctatgacgagattctataattttatctaaaccatcaaacgcaccaccaaatataaataaaatattatcagtatttatttgtataaactcttgatgtggatgcttcctaccaccttgaggtgggacagaagaaactgtgccttcaataactttcaataaagcttgttgaacaccttcgccagatacatcacgagtaatagaagtattttcagactttctagaaattttatctacttcatcaatataaattatgccacgttgtgctgcatcaacattaaaattagctgcctgcaataattttaacaatatattctctacatcctctccaacataccctgcttccgttaaagtagtagcatcagccatcgcaaaaggaacttgtaaaactctagctaaagtacgagctaataatgtttttccagaaccagtaggtccaatcaacaaaacatttgacttagaaatctcaacttcactaataacacttaaattcgataaacgtttataatgattatacacagcaactgataaaactttttttgagtgctcttgccctataacatactcatcaagaactttctttatttcctttggttttaacttaagagtatccgtctttttataagatctactttcttcttgtaatataccactacataaatcaatacactcattacaaataaaaactgatggcccagcaattaacttacgtacttcactatgaatctttccgcagaaagaacagctacaagaatttttttcattatctgccatatctctccaattttaattactctaccccaatatcgagacgcttctcaataactttatcaataataccaaaatctttagctttctcagctctcataaaattatcgcgttccatatttgcaacaacttctgataaatctcttcctgtatgctttacataaatatcattaagcctacccttaatatccaagatctctttagcatgtatttctatatcagttgcttgtccttggaaaccacctgaaggttgatggatcatgatcctagaattaggaagtgcataacgcattcctggttctccagcagccaataacaaagatcccatagaagcagcttgccctaaacataatgtagaaaccttaggttttatatactgcatagtgtcatatattgataacccagctgtaacaacaccacctggagaattaatatacatacatatttctttttctggattttcagattctaaaaatataagctgcgcaactattagacttgccatttgatcttctatcggtccagttatgaagattatcctttcctttaacaatcgtgaatatatatcatatgcacgctcgcctctactagtctgttcaactaccatggggactaaagtcatagccatctccttttctttacaatcactataaatgctgtcttaaactaatccatttaatataattttacaactatatattctcaaacataaggcttatatctttagctgtcataaccttcttgtcctttttggccagccctattatatagttaatgaccttttcttcaagtactttcccactaatataattagcaaaatttttattagattgcagcattttcaacacattaccaatatctactccataatcagcataattgctctgtatgaagctaaaaacatcttcatttttaatagtaatattattatgacgagacatctttatcagtaacataccaagcttaactcgctttattgcttccttctctacatcaatttgtatatcttctccagaatcacgtatttccttgtttatttttgcaatttcttgagtaacaacacactctggtacatctataacatagttagcatccatataatcaaataattctttcttcactatagtgaaaaccatttgatcaaattgttgctttattcttttcctagcaaaatcttccatatgacctacatctttaaagccataatcttttgctatagcttcactatctcgcatacctttcataacatatacacttttaacagtaactgacatatctgtagtttttccagcaagatgtaccataccataatcgttagggaaagttagaggaaaagttttagattccccaactttcatacctatcaactgatcttcaaattctcttaaagctacacctttacctaacaccaacacaaagtccttggcagaaccgcctctcaagattttaccttttattttattttgataatcaataactaatttatcactgccttgaattacatattccggatcatccactataacaaaatcaggtctttgtttttttaaattttctataaattcattgacatcacactcttgtatatcaacttctatatcgcttaaaactatattatcaatatccattaatggagcttcaggcataacctcaaaactcagtttatagactaaatcttcttctttatcattatcagagtaatagctaggataagaaacaatatcaatattcgatgatattatctctccaaatttactatttttaacaaaatcagaagacgtactttcaatagtcttcttcactacactagtcatagcttcatttaaatattctttccttactaaatcaattgaagcctttcctactctaaagccaggtacctttacattcatagcaatctctgacaacttagaatctaactggtctaaaaaatactttttatcaacagcaaattcatattcccacttcaatttatcatttgaaacttctctaactacataactattcagcatattacaatacccttactgatatataaagtgcggatagagggacttgaacccccacaagtttccttactaggacctaaacctagcacgtctaccaattccgccatatccgcacaaaaatcatcgctacaatattaacaaactatcaagcaccaaattatagacacttatcagataattctcaagattttataatcaagtagtagactttacaatacgagataattttattataccagccctattataacgatcacttaactacattataaaacattcacaactttcaataagtgatcccggtgtgattcgaacacacgacatactgattaagagtcaatcgctctaccaactgagctacgggatcttataatttaccacccttaagtaattagactaaactttgataacacttttgtcaaattcaaacacgtaaccttttactttattatttgattaacattgtattaacataaaatacctatttttcattaaactaatttaatatttttttcaatacggtaatcttgactattaacactataaattatacaataagtggatgctagattagcataattacggagttttcatgctgcaaggttacatcacatgagattattacaaattctttttcttatgatattaatgtgcactatatctagttgtggtactttttcaaaaagagagcgcagaattaagagcccatgcatcaattcagtagacagtagttcagattgttataagtaccgtgtaaacgatcattggttaaaacatcagtaattagcatattaatacttcttgtataagaagttaggcttattttaatagtttaagtatttttatttttttcatgtagaggtagtatgcaattatatacaatagtagctacatggtttggatgtggaaatataactagagctccaggaactattgctagttttgctacaatgctactttctcctgctattatattaaataatttatttggcatattaattatcgtattaacaggcatcatgggtttatttgcaattccaaaatatttactggaccaccctaatatagttgaccctaaagagattgttatagacgaagtcatcgggcaattaatagcattttctatccctatagtcttcttcagatattatcaatacgtacctcagacatttaacactttgtatttattattttatattaaaatactcattacaagttttatattattcaggatattcgatataacaaaaatatggccaataaatattcttgaaagaatatctggcactaccggcataatactagatgacgtacttgcaggtattatgtcctctatatgcactatatttattattgctaaaataggtacttagagtggaaaatgaacatatttcttccttggtaacaagtaacttaaaagattacatgatacatacaatgcaaacatcaagtctagagattcattactttcaaaacattacgttaaccatcaataacagtaagagttccttacttaactttgcttttcacgatagtacaacaaatgaatgtaatgaagaggctgtaaaagaagttatacaatttttaaaaaagagaaacatagacgcaacatggccagtagactctcacatgaaaaaattaaaaatgactcttgaaaaactaggcttaataagcgtcagtcttcctaaaaaagctcttgcaaacatagaaaattacattatgccgcccacaaaaggcccaaacattacgctagatattgtaaataataaagaaaagttattagaactagatgacattgccttaagagtattttatagtcaaaaaaatgaagtggcaactttcttaagagggttagctaaccatcatgatatcaataattctaaattaaagtttttcttaacaaagtgtgataacattaaagtaggtatatgtggaatgtatgtacaagataaagttgtgggattttatagtgatggtgtacttcccgaatatcgtaataaagggatagcaagccaaatggtattagaaagaataaaaatagcaaaaaaccaatacaattgttcttatgcagtagctcaatgtatgaaaccttctgtaaatctatataaaagattaggattcaaaatgcttggtagtttgtctttatacacatctttggtgtaggaatttactagaattataacagattaagaagatacattattatgtttacttacattaccatttttttgttaatatttgttttaggtttattaatcaatgcttattatcgtgctaacatcaacatttgtgctctaaaacataataataatcttattaacagtttattatcaactttaggagatgggttctacctttgggatgaaaaacggcgtatagaaaaattttctccgaacctacaaattttacttaacactgtattctattcttttgacgaatttgctgacttttttgaagaatcaaaagaactacaaaaaaagtttactgaagctaaaaaagttaacaaatcttttactatagacttaaaaggacaagatacagaaatttattgttcttgttatgggcaaagtatagtcgacactaatggacaaatcataggagtcttgctgtgggtacaaaatataacaaactataaattatcaataacaagcttagaatatgaaaatacaaaattaaaagagaacctactaaactacactgacatattaaacaacttaccatatccactatggaaaagagggaaagattccaaaattaagactaagaatctattttattctgaacttgtacaacacaacttaaacatagacacagcccacaatacacgacttatcaataaaaagaacaacaaaattagtcaaaaaatacaatacgctatcatcaataatgaaagaaagctatacaacatggtagaaatcccaattaaaaactcaaatgaatttattggatatggagaagatatcacacgacttaattattttgctcaagaactaaaaaattatactaccctacaaaaaaacttattaaacaaccttccaaatgccgtggcaatatacaatagagatggatcaattatattttacaacagaattttcacaaaattttggcagttaaattcttcatggctagatactcatccaaactactcaagtattttgcaaaaaatatacgaagatagtaacctcttagacaaagaaaaatttgacttaataaaccaacaacaatatgaaatatttaaacaaattactgaaccataccacggaactatggtattaaaagacaatactactttaaaaattatagtaatcccaaactttaaacaagaattaacctttatatacaacaaataatattgctttattttgaaaccaacgcttccaatcctttatttattttgacgctcctcataccaagacaactgtatagattcaagaatcttttcgttacacccattatcatcgtcatcaaaacctggtaaccctaaaatcattaaacgcaactctgtaaatctagtattgaatatatcatgttccgggtaatggtcctctaaagatatagcaatactatcaacattattccatttcatataaacactctacctgagattataacaatcattgcattatatactacaaaaatataaagtaaactacactgcaatatactaaaacacaaaatatatttcgataaaggtaaaaatagcaagtaagtaatatttaaaaacatctcgcatgatgaattacactgtatagattcattaattagattattaaacctcacaataataccccacttcagcattacataataacatacaacctcgtgttctaactaaacataacagagcatttaagtaatatttaaggaataacttgcatgatgaattataactatatagattcattaattagattattaaacctcacaataataccccacttcagcattatataataatatacaacttcgtgttctaactaaacataatagagcatttattgtaaaatcactcaaatcaaacgttcatgcttaatctaagaaaaatatcatcatatacatcccaaatacctaaaacaaacatacaaataacaaaacaataaccctataacaaactgacacatcatttcaggtatacaaaataaacaatctaacttttcttcatatgaacactatacataactttagataattataaacacacatctctataaaactatagctactaatatttataggttttcttatcctttaactatatttatcacaatggtttctcaatcagcattattataaaatttactacccatatagtgggctataagtgctcttacaaatacaccaactattgctgttataggaattgacaataatacccctgtaaatccaatttgtgatccacatgttatcattccaataattatccatataggatgtatatctacccgttttcctattaataatggagtaataatattcgactcaactaactgtccaacaatgaacattgtcactaccactccacacatcgtccaatcattaaactgtaacattgttgtaatggaactcaatattgcacatgaaataggtcctatatatggaataaaagtcatgattcccgatacaaaacctataattaaaaaatactttaacttcaccaaactaaaacatataatgtagtatacagccatgataaaacatacacttaattggcctctaatataagctgaaattacttggtctattttttttgtatataatctagcaatactttgatattttacaggaactagtgcatcagcagattcaacaatcgatggccagttacataatatataaaataataatagaggagttattaatattatagaaattgtataactaatgcttatactagaatttattgcactaaacaatataccatctaaattttttagaaaatttccaaaaatacttacaagaggtttaatgttttcgtaatgcaacaaactttttaaagacgcttgcggcaactttattgcatccgatacttcttcataatcaatcatattatatttctgaaggagagaaatgatactgtctttatgaatcaatggcactttttccataagaaactttataagtgataacaactgagaataagcaaggggaataaaactgaccaaaaatgctataattacacacaacgaagatagcaaaattatagcaacagatagttgccttgatagtttaaatctttgtaacttatccaccaatggattaagaagataagccattatcatagcagtacaacacggagcaagtacaggtttaataacaaacatcaccaaaacaattgctagtacaataacactacgtgttacatacctattaattagcttgcaaaattgatcgctcattagtctatgcacatgcatttttaggtattatactattttagtattttttgcatagatatattatccacttactagcctgggttattaaaaaactctaccacatttaacaattattactctaactcttgctcactatacaaatatcgtaataagaaaaaaaaatgctttctgacattactttagagatgatttttgtgcggatacagcaaaattggtagacgtgctaggtttaagtcctagtaaggaaacttctaggggtttaagtccatctatccacactttaagtatcagtaagagtattgtaatatgctgaatagttatatagttaaagaagtttcaaatgataagttgaagtgggaatcagtttagtaaataccaccagatcaaaacccaactcgatgtatgaagaacattagtaaaaatggtgcccacggggagacttgaactcccacgatcttaattgatcaacggattttaagtccgcaacgtctaccgattccgccacgtgggcctacagactacctagagtagaactctattaccaaattaacttccatagttgctggatacggtacttcacaatacttaggtaccctcaaatatcttatagatttttcttgagtatcgacttctaagtagtcaggtaccttttgctcttgagattgcactgcaaaaacaactgcaggtaaattttttgctttttcttttagtgtaactacatcacctactttcacaacatagctagatatatttactgttttaccgttaaccaaaacatgtttatgggatattagctgccttgcagaaaaaatagttggtacaagcccagaattatacaaaacactcgataacctagattccaataatccaacaaaattatcaccagtatcgcctcttttcttataagctttcaagaaaatattacgcatttgcttactatttatagcataataaaacttaaatttcttatgcgctgcaaactgcttaccaaagtcagaaggtttcttataacccataccgccatgctgaccaggaggataattccttgtattaaatggatccttagatctaccccaaagatttacacctaacctacgacttgctctatattttctctgtattaccatatacccttatttataaacaacttaaaacaatacacgagtactaaaaatactcttaatataacatgatgtaaacatatcagtcttgcaaatacaaaactgcatagattttagtatcataactttatcaatacatgtcaacgtatttttacgaattcataactatacatttatgacatagtacttacacaattaatgtatttataatccctctcacaatttataccacttaccagttattcaactaccctatatgttaaatttactagcatggcagcagcaacaatattactattataatgaaaataaattcatacatggtaattgataaatgcaactaacattatttgatcttgaagatagttattcataccattaccacgactacatactgttagagcaaaacagaacaacatacaatatgctaatgaatcaagaatggaactccttcattctatatggaaaatcaggatcaggtaaaacccatcttgcacacatatggcaaaaacttaaaaatgccatttttattgaccaacatctaatcaacactaaaaaagatataggagacacaatatcaaatggtaacgcctttataattgaaaatatagataacatagataatgaactatcaatgttacatcactacaactatataaaagaaaacaaaaaattattactaatgacttcttctatagctccaacattactcaactatcatacaaaagatttaaaatcccgtatattacatactatgagtgccaaattagctaacccagatgaagaattattaaaaattatgcttataaaactatttgctgataaacaaatacacatagaactaaaagttataaactatattctcaataacacagaacgttcttttcaaaatttgagcaatatagtaaaatgcatagacagaaacctaccttactataataatggcgtcactataccatttgtaaaatctataatagaaaaaaatgactaaacatcaatataaaggtcgagtattaactatagccggttctgattcaggaggtggtgctggtatccaagcagatatcaaaactatatcagcattgggatgttatgctgcaagttgtattacatcagtaacagcacagaatacaactcaagtttacagtgtatataatatgccacaacatattatccagcaacaaatagaagttgttttatctgacattaatatagacaccattaaaattggtatgttaccttcctctaaagcaataaaagcagtagcacaatccttgccagatatccctattattgtagatccagtaatggtatcggcatcaaattttagattaatggacagtagtgcaatttctgactttatagaatatataattccaaaaacaacaataattacaccaaatataccagaagcagaagctttagctcaaattgagataaaagatcaaaatgacatgacaaaagcaagtaagataataaaatcacttgggactaaacacgttctgattaaaggaggacacatcaatcaagagattataaataacattttactaacagaagaaaatcaaattataaatttctcacataaaagaatatctaagaaggaattacatggcacaggttgtactctatcgtcagccattgcaagttttatagcacagaagatgtcaatacaagaaagtgtaaatctagcaatccaatatatcctcaataccataaagatagtaccacaaataggaaaaggcaataatcctgtcttccataactacaatacaatcagtagtgacctttaatttaaaaaaatctataacttttatatagagaaaatttcatttttacactgtcagtttatagctcttaatttaacgaaataactcaggtcttatctgtcacatacacactttaagattaataatacatacaaacagtccaaccattaaactatcaagcaaaaaaatatattgaagattcagaagtagaatattttattatgttgttaatattacacacctgtttaaaaatgttttacgtgataatatgttgtaaatacttttaataatcacatatacgcaaatctattaccgttatcaggaaataaataatacccttattctatcattcagttaattttattatgataatatctgttttatacagcctagtagatgttcttttttgtttacttagttctttactaatatcctccacatacacactttaagattaattaatgcatataaacagtctaaccattaaactataaagcaaaaaaatatattaaagattcagaagtagaatattttattatgttgttaatattacacacctgtttaaaaaatgttttacgtgataatattttgttgcaaatacttttaataatcacatatacgcaaatctattagcgttatcagaaaataaataatacccttattctatcattcagttaattttattatgataatatctgattgttatacagtttttgcagatgttcttttttgtttacttaattctttattaatatcctcactcgtaccacatataatttgctcactcagttcaccaccaagtctacttattgcttccaaatctctacgactaattttcttcttctgactctgctgttcttcctgttttggctcttctatacctctctcagaatctactataaaaccatattgtccgcttacatgacttctcaaaaatttttcatctccacctaacctagctttacatagtaaacttgttttaacaaaatttacacctgaatccctgatacctaaacacaataacctagctgaatcactgatagcagacatccccgccattactggtaaacatctcatattacgattatgtataccattcgtgatggcactagggaatcttattataccttcgcacaaactagcagaatgtctgacaaaagatgaacaacatgttaaactattactaacaatagacaagaaaaacataaataatgtagcagcatatggtctatacctacctggtaaaaccccagaacttgtatgtattatttttttatctactctttgagcaatatatgcagacacattatcacaacatcgtgctacacctaacaatattgcaccaaatgttctacctgtacacccaattgctaacccagctaaattaaagggtaacataagcaaagaaagtggtaagttagtctttttattctcatatttacaaacagaaaatgaataaggataaacttcatgttcactactcaacatgacatctctattattacgtttccctacaggatcaacacatttacttccatcaaaagctacaactaatactttattttcctcttctttagattcaaaatcctcataattactaagcccagcagtatttattgcatataacatatgtccttgcacattaaaaattggcattttgtcaggccctgttaacggagtaactggatatctttttcctttatatattaaataatctccttcaatctttaatcctacattatgacatttacttggtatatatttacatgtttgacttctatgtaaagctggtagtagcgctctgcacttaactttttgattaaccccaaacgtaggaaatgctctaagtattggtataacaccaaaaaaaccatatactgtacgtacaccattaaatatcttcaatggagtagatggtatagctctaacaccacccctaatagccctaaaaatattactaaacatatcttatcaacactaatattacaaaaacacctacttaactatattatacaatagtaaaaaaattaatatcaaaaatatttaatataaagaacataaagaagataaaaaacaattgaaatattatataaaaactaataaaaaatatttagcttacaacacacagggaaattatctatcaaaacccttattcatctaaatataaaaaatgaacagaattaatatcctaacagtacactatataaaattataaatgttaaaaacaacacagttaaaatcacaattcctttaataacaagaaatacagatgctcttaacacaacagaatgtatataatcttctaatataacctgtacacctagaaccgcatgataaaatgcagagataaaaaagcataataaaataataagatcagtattacttatatttgaaatagacaaatgaagttctggaaaagatttaagtattatagaaataacaccaagaaccttaaataaaaaccacagagaaagaggaattaaaacaaaagccgtaaccctttgaattaaccaatgataaactgaatgactaaccataattttatatcattaacttaagaaaaaactataaagtataaaagatgagactagacataaaaaaacaactaccactcccgtagttctcaccgcagatttactcaaacccaatcctaaatcccagaaaatatgccttataccattcatataatggtagcacaatacattcaaccaaataaaagttattaactttagagaatataatgaaacataagaattacaaaaaaaactacaaattctatatactacttgaggacataaaaaagaaagaataaaaccccatgatagaaccagcagacctaaaaatagtatcataccagtaaacctatgcataatagaaagcttatatacaactttgtatatttgtaaatgcggtgataaaggcctaacttttgacattatcaaatttcataaaaataaaagaaatttatgcctaattacaggataaagattaactacacccttaaccatttagacaaaacaattagacaaaatagaaataaagacggcgtagcagcttatcaaaacattactaaaaaataacattagataagaaagcctaaaaggaggtaatccagccgcaggttcacctacagctaccttgttacgacttcaccctagtcactaacccaaccttaaatggctgcttccttgcggttagcacaccagcttcgagttaagccaattcccatggcgtgacgggcagtgtgtacaagacccgagaacgtattcaccgtggcatgatgatccacgattactagcgattccgacttcatgctctcgagttgcagagaacaatccgaactgagacaacttttatggattagctaaaccttgcggtctcgcgacctattgtagttgccattgtagcacgtgtgtagcccaccttataagggccgtgctgacttgacatcatccccaccttcctccagtttatcactggcagtttccttagagtgcccagcattacctgttggtaactaaggatgagggttgcgctcgttgcgggacttaacccaacatctcacgacacgagctgacgacagccatgcagcacctgtgtaaggtccagccgaactgactccccctattaggagggatacgaccttcatgtcaaaaagtggtaaggtttttcgcgttgcatcgaattaaaccacatgctccaccgcttgtgcgggtccccgtcaattcctttgagttttagtcttgcgaccgtagtccccaggcggagtgcttaacgcgttagctacaatacaaagataaaatcctcacatttagcactcatcgtttacagcgtggactaccagggtatctaatcctgtttgctccccacgctttcgcacctcagtgtcagtatcgaaccagatagccgctttcgccactggtgttcctcctaatatctacgaatttcacctctacactaggaattccgctatcctctttcgacctctagtctagcagtattaaaagccgctccaaagttaagccttggtatttcacttttaacttactagtccacctacgtgccctttacgcccaataattccgaacaacgcttgccccctccgtattaccgcggctgctggcacagagtttgccgggacttcttctataggtaccgtcattatcttccctattgaaagagttttacaacccgaaggccttcttcactcacgcggcatagctggatcaggctttcgcccattgtccaatattccccactgctgcctcccgtaggagtctggaccgtatctcagttccagtgtggctgatcgtcctctcagaccagctatagatcatagccttggtaagccattaccttaccaactagctaatctaacgtaggctcatctaatagcgataaatctttcccccgcagggattatacagtattacccatcatttctaatggctattccatactactaggtagattcctacgcattactcacccgtctgccactaacaattatttataaccaaaaggttataagcaattgtccgttcgacttgcatgtgttaggcttgccgccagcgttcgttctgagccaggatcaaactctcaagtttgacaaaccataattaattatggcttggactcatgcaaacaaataaataaaatacgtcaatgcatgatataaataaatatagctatatgcaccgccgcctttatttctattctataaacttaaactattcaaacaacttcatcaattatgacacttagccatgggttgaattatcaattaatatatgattaatgtcaatacattttttaacattaattttaaaataaaaaattaggcaattctaattttcgctccatgtttattaaataactcaattattgcaaacaaatcatttgtttttctcgcattttttattttaataaaattattagaaatcatacccatggtcaaaaataacactgtaattttaaaatcgtaacatgcgtctactgtaccacaatcaaaaatattattagaatgaccataaataattaagcgatctgcttctatttctatcattaccccacatttcatcaattgcttaataaccactcttaaccttttatctgtaagtgttctatttaatacaccacttaaaactgttataccttcagcacatgcagctatcatcactataaataaatattcatcaatatcaaaattttcattgaacagccactcaattccttgtagaacactccccttaaccacaagatctacaacttcttctcccactgcattttttctctgatttagaaagaaaagatttccccccattttcactaaaattttataaaaatttttcattttatcattgaacaaaacatccaatatagtgatttctgacccctttaaaatcaatgctacagttataaaagataacatacaaaaaaaatcgttaggaatacatacattcttggagtataactcacgttgaccagatatactgattaccgaatttttatccaccaaacattctatcgcaacattaaaacgttgtaacatatttacaatgctatcttgagcagtagtaccaactatagttgtggtaccatacgtatttaaagcagcaaacattattgccatctttacactatcttccctagtcgtatattttataggtaacatgtctatacagccaactaaagcagcgggtaatttattattatttgaaataaatctcgcacccattaagaataatggcttcattacattgctaatatttaaattaacctctccatgtagaaaagatgtaaaaggacaattagataaacttcctattatcatataaatagatggatcattaaaacataatatatcttttgaacaaaggaaacctcctacacccattccttctacagtacaaatcttactatttttattatatttaattttaataccaagcgaatttaaagatttaatagtaagtgctatatcgctgttaaagacaatatcataaattttagtgacacctattacctgagatgctaagattaatgttgcatgtgaaagcaaactatctttcagcacgctcacatggccagatatacgatatattctctcagatattatcaccataaatattacccctactatcaggatataattatcataaaatttctagatctctatattccaaactatatattaaaaagatataatagcattagagatatcatcaataaattatattaaaagtgtacaacacatcagaaaatctaaaatacattattaaatacaaagttatatcttatacactcacccaatcataaacacgaaaagtactaccagcgatacatctgaatacatataatacatttctaaacattacaattaccaattaatacaacaattatttaggtaaaatattttgtgttatcaaacatttaaaaagaaatacgctatctatttttaaatacaactcaccataaattaaagcaacattaaactaaaatgctattaatctcaatatcctttacccaatttaacttaaaaatttgtgcaaaaattaaaggagtaactaaaaagctatttggcaattgaattgtcacatgatcatttggaagaaccagatcaattaatacaacagtagatcccctattctgcaacaaactagatagctcttttattacaacactattcttagcattaacatgtataaccatagtttttataatagaagaaattttgttttcaaaactatagatatttttaccaagtaatcgtactgaggcactataaaaagtattatccatctcaataattacagatgcaccagtagtaaataagtctttattatcttctattatatttccattataaaaaactatttcatgaatgttaaaaggatcagaaagagttacaactgcaaacttatccttatttgtagaacgcactttaacattagaaattatacctacaatcacattattataagaagatttatcatcgtagtgaataaaacctatattcaatttgtctaaaagatacttatagttttccatgggatgatgattaagataaaaacctatagaggaaaactcattattcagcttttcttctttagtccaatcatcagtttctgataacttataatgatttttatcattaaacaaactaaattggttaaaattagcattatacttattatattcaataatatctaaaaataaaaatactgattcaaaaagctgctttctattgctatgaatactatccagaacccccgctttaataatactttccagtattctcttgtgcacacatttagtacttactctgtcaataaaatcccatatgtctttataagcaacatcgtctactatctcttttgctgaatgctgtcctacattcttaagagctccaagggcatatctaatagacgatgcaccctcaatagtaaacaatactttagaagagttaatatccggaggtaatatttcaataccatgcaactttgcttgatgacacaacatttctaacttatccttatccattatatctaaattcatcgaagcagtaaaaaattccaacgtataattagctttcaaataagctgtctgataactgatcaaagcataagctgcagcatgtgatttattaaacccatatcccgcaaattttgctactaaatcaaaaatatagcttgccttctcttcctctattccattgctaacagcaccatttataaaagttctgcgttgattatccatctcctccttaatcttttttcccatagcacgccttaacaaatctgcttcacctaaactatatccagccataatcttggcaatttccattacttgctcttgataaattataaccccaaaagtttctctaaggacatcttctaaaattggatgtatataatctggtttttcaaacccatgcttgcgtgctatatatatagaaatgttatccataggacctggcctatacagagaaatcaatgctataatatcatttatattatctggcttcagcttactaattacttccctcatacccgaactttcaagctggaatacaccaacagaatcacctgcagacaacatttcatatgtttttctatcatttaaaggaatacgtgatatatcaacactgtgacctcccctattaactaaatgacaaatttgatttattacagttaaagtccgcaatcccaaaaaatcaaatttcactaatcctgctttctcagtatatttcatattatactgtgtaataggaagagaagacgtgctatcataatataaaggcagtaattcttccaattctctatcacaaattacaatacctgcagcatgtatcgaaacatgtctatacagcccttcaagctttaatgatatttctaataatttagcaactgtttcatcatcatcctgctctttctgcaaatttttatccatctctattgcttcagataaagtaacaggcttaactgggttgtgaggaatcattttacagattctatccacctggaaataaggcatctgcataactctacccacatcacgaagcacagccttagcttgtaattttccaaaagttataatgtgagcaacgtaaccatatttctttcttacatactctataacgtaatctctcttttcctgacaaaaatcaatatcaaaatctggcattgaaatacggtcaggatttaaaaatctttcaaaaattaaaccaaattctatagggtcaagatcagtaatttgcaaagaccaagcaacaagagaaccagctccagatcctctaccaggacctaccattatatcatttcttttactccaacatataaaatccgatactatcaaaaaatacccagcataatccattgagataataatatctaattcataatgcagtctttcatagtacttggaaacttgttctgtagataaacttttactttttaaacgattatccaatccattaatagcttgacttattaattcttgactctcatttttaccacttgaacaaggaaaatgaggtaacataggtttcctggtttctggcataaaagaacaacgctgtgctattaacacagtattagaaactgcttcaggaatatccttaaacaacctatacatctcatcagaagacttaaaataatgctcttctgtgaacatctttcggccttcctgtgcaatataattaccatctgatatacaagataaaacatcatgcgctaaaaaatcatttttcttagcaaacaacacatcattcgtggcaaccaatggcaaatctttctcataagcaaaattaacaagtgttttttctatgattttttcctcttccattccatgacgttgaagttcaacataaagattcccattaaaagcaagtaacaacttatctataatgccatagtcaataacattacctaacaaaagttgggataaaaatccatcatgacctcctgttaaaacaataataccatctttcagatcaataagtttttctaaatctactctattaactttgttggactggctatccttaaatgaattactaacaagattaacgatattattatatcctatttgatcttttactaataataccagttctccaatactatcaccattatagctcatcattatgttacagcctataataggctgtacacctaaactcgatgcataatcagaaaattccaaagatccaaataaattacctgaatctgttaatgctaatgcaggcatattatactgcacacataagttcaccaaagaatctatttttatcattccatgaagtaaggaataatcactatgagacctaagatgaacaaatatttgactcataatcaccaaatttaataagcaacctttatagtgtaaataacacaaacatattttcgcgagagttataaatttatgtaatcaccctcaaaactattgtatgctaagcaatacttaatttacatttaatagacagatatacaataataatttgtaacaacaaattaaaaagcaaaattggtaataaaaatgactataaccaaagtgttacaaaattgtcgaacgcttacttttaataactaggaaatcaacagcttactctacattaacaatacataactccactaaaatcaataaagtagtatcctcaacaccaccgtgtttttcattaagcagtccaaatttaaaacgattaaatatttatcaaaaacaataacttaagttattatacaaatgcaaacaactatgaatttaagaatgaatgttggtgagtttgataaactataggtattttagagctttttattttgtttaaaaacatgggatttgtacaaattatttacactttagagtgctataccaatacacaaattaaatgatcagaaaaaacaatcatgttacctgcattaaacacttgatatatgattaatagtaacatcaataatgcagtatttttacactatatctttcccatcaagcattaacattccaaaatcattaaacatctattaatgaataacttaattcactacaaaaattatatataaattaatatatgcaattactatttttagtaataaacaacaaagacactttaaatactgtattctctttttatacaattacatttcgtttccccctagatcacattttggcgttaaggttgaataaaaagcaaaaaataccaccgttctttattacaaaaacataagttataccattattatacagacattttcatatcctaatcactcaacttcgcacgcttagaaaacgctttataagcttttactgcattcaatataatttcatcagcacgtaaaaaatcataatttttcttataatcaatagttaagtgattattctaaatattaccccaatttgtaacatcaacaatagcactatcataatccctaccaagcacaatgattcccctgagcttgaacataacagctaaaaagtttacaccaacccaatttaagtttttcgggttgtccacaaacaacatggacaaaagcttgttgattaaaccataattctgttagttcatatttaaattgtgcaatatttgcattagtagtaaatacttgatggtgtaaattctcataaagcttatcaatatattccttacattctgtattatctagcataattctaaaaaggcctgctctagaagtattaacccatgtgtaatactcgcattaggagcaaatatttgatgtgcaaattctcataaaacctatcaatatattctctttctgtattatctaacataattctaaaaaggtttactctagaagtattaacccatgtgcaacatttgtgctaggagtaaatatttgatggtgcaaattctcataaacctatcaatatattctgtattatctaacataattctaaaaaggtttgctctagaagtattaacccatgtgcaacatttgtgctaggagtaaatacttgatggtgcaaattctcataaacctatcaatatattctgtattatctaacataattctaaaaaggtttgctctagaagtattaacccatgtgcaacatttgtgctaggagtaaatatttgatggtgcaaattctcataaagcttatcaatatattccttacattctgtattatctagcataattctaaaaaggcctgctctagaagtattaacccatgtgtaatactcgcattaggagcaaatatttgatgtgcaaattctcataaaacctatcaatatattctctttctgtattatctaacataattctaaaaaggtttactctagaagtattaacccatgtgcaacatttgtgctaggagtaaatatttgatggtgcaaattctcataaagcttatcaatatattctgtattatctaacataattctaaaaaggcctgctttaggagtattaacctagttcctacaaacatttaggatttccctatcaacaaattcattaagttctggaggaacaaggaaaattacagttaatattcccaccagcagattcaaaaatagtattcattatgattcattccttaaatatccagaatattttacttgatgtttttttaagctttcatcaggaacactagtgcatgaacaaacaataaaacttactgtaacaaaagaacccaaatatatctgaaaacttccataacactaccttaaacatacataacaaacataagattcagcatgcaaaactatcattgcaagataaccactcatttaaaaaaacatcctatatacttatttcataatattgtataacgtactaaaccttataattaagatataactacaacaatataaaaaacccataatcttacaagtaacagtggtactcaataacccttaatcataaaaccatctactagaaaacaaaactaacacctctgctacatgaacagatatacaccattgtattacataaaactatattagtactattattcattagtaaaacacaatcaaaagttacaaaataaaatggctaaacaatacttaaaattttacctatgttacatacacactaaaaactactttagcaagtaatagctaagcaattaatatctcttcagtaaaaacaaaaccaataataatgcgctactgtacagtttactacataattaacgtacagtagcacaataaattgatactgactatttgatacagctacattctgtttcacctcttctacaatttggagttaaatctgcaaaaaatgtaacaatagaatttttacgagctacaaatacataagtaacatcttcattaccataaagacaatgcctatttctttgttccgctaattgagaattttgagacaaccccttgtaagcacttgtagcatgtaatataatttcattagcatgtaagaaatcataaccctttctaggatcaactactaattgcccattaacatttttaaacataactccaatagtaaatactttatcactaacttcatcagtcaaatcatcatcataatatctaccaacccacttattctcttgagcctgcaagtaacgtccaaagaaatgcataccacctaatctacctagtttaggctgtccacacattatatgagtaaatccatctctattaaaccacaactctgctaactcatttttaaatgtctcaagatccgcatttggagtaaacacttgatgatctaatttttgatataactcatcaacatattctttatatttttcttcatttaatatatttttaaaatcctctactcctggagtactaccccaatcaccacaaacatctaagacagctttatcaaattcattaagcagaggaggactaggcagagtaccacacttagaatattcctctgttttgaaaaaaggatttataccagatgaattattcacacattcatcaggcgtatcaacaacagtcacacatgccattaggctaaatggcaatagaaaaaaacatacatatatatacttatacaatctcataatattattcctcacataacaaaaaaaaaattaacatatctcttattagcataaaaatgccaaatatcatattattcattaaaatttttattaatagtaaatttgctattatttaaaaaaccattaactacgcaaaataaaaatgttacaatacaacaaagttaacattgcaaaaactaatggatatcattcaaaaaatagggaataaaattacatcatcattaaacgtattaaaactcgaaataacagatgagtcccaaaaacataagggtcataatttccattccatctccaatatttcacatctaaaaatacaggtagtatctaatgattttttagaagtaagccaaatcaatagacacaagttactacacaaagttttagagaatgaaataaaattaatacactcaatttcgtttttactttatacagaagtagagtacaacaagctcttataacaagcagataagtattgctatatcagtcatgcatcaataaacaacattgataaaaccaataaatatttacttatttcatcccctatatagtaaataagctattctagtagctagtataatcagaattttaacacttaagttttcgaagtaaaccaaaacaatactaacactaacagattatcatataaagctttaaaagcaattaattgttgtatataaatttataactttaggtaaacttataaaatcatatcatattaattttacaccatgaacacaagcaactatactctttatttatgaacattatccaagatgtattaattattcaaacaaattctattcactataaaaatttcacttaagttttactgtaaacatattcatcattaaccctacagttatggatacagcgatacaacattccatttatccatattattactatccctagtatattgatatctagtgtgaatcctatttaaaccttcctgccaaaattccattaacattggaaccactactattccaacccaataatctggtctaggtattggtttttcatggaattttattgtcatttcttttattaactcaacaaaatcttccctattttctaaaacacttgactgcttagaacaccaagcacctatctgactaccacgaggtctagatgcataatactcatctgcatcattacaaggtagcatttttattctcccttcaattctaacctgctttgaaatacgactccaatcaaaaacaagagcaacagaaggattttctgccatttcttttcctttccgactattcatattggtaaaaaatacaaaaccttgatcactatacttttttaacagaacaacccttgctgaaggtttcaaatctttactacatgtagcaagcaccattgctgtaggatcttttttatcttgtaaagaaactgctaatacctcattataccataaatcaaacaattcaataggatctttcttaatcatactctacctttaacatcaaccaacacagacattttcacactctacttaattatttaatacataataaggttatcttacttatttaatgatctaagatatttattgtactctcattataaattagtagcattgatttttaagaataacacgttagccattttacagcacataataataaaaaatattcacttacacctttcagatattttttatgtatttcctaatttacagcagcactgacaacgtatctctgaaataaagataaaaaatatgaataggcaaaagcactctgtaccaaatatgtccttaactattgattacatatctacctgctaaagcaaatatgtaatcatttagacattttcagcctacaaaattttataaaaagcatatcataatgacacaatgtaacacagtcaaaagtacacaacatatcatcattgactcttcaacatataacctataaacgttgaattctttcatcatttaaaagcacctcacagaaatcatttatatttttctcattctcttgcacaatcttttgagcatctttttgtacattttgtatatttcctggagaagcatcactaaaatcacacgtagaatatatgatatcaccagaaatcctacaatacgtatcctctccttttacaagtctagccatttgataatctatagcatccaaaccagcatcaataataacaaaaagtatcttactagaccaatacaacaacgaattttgcaaatctgaaaaatccttatttacagtaccacatcctacagacaaacaacataacttttcatttggatataatacttgtgctccagcatatgctgctattatagggttattacatacaatagaactatcaatcaataatgttttttttaccctctacaattatttttttaggagtaaaataagtaggagcagctacagcaccccttgtcacatcagatacttttatatcatgatacttatctacccaacttctaaacattactgtttgattagaacataaatcataacttggtacaataaaatttgtcatcaagtccttcattgcaacatccccaaatatttcttttagtactgaattcaaatttttatcagaatatttaggaccaaaaattaatgcaaaagcatttctagcagcagaattggaaaaaattttaccagaatactttaacatcaagtctaataaatcccttgtattatatcttggcataccatcagcattcttaaggcaaagcgctccacctacaagactaccaactgaactacctgatactaagtcaaatatcttacttaacggtttatttattctcttttctatctcttgtagtatagttgctgctactatgcccctaactcctccaccatctatcgataaaatatatctagtcataactatatcctccatattattaacttgttaataaatacaaactaatatcagatttgaaataatataaaacaatacagctgatacgtacaactttttgttgagcatatcaatacaataacccttcttttatgaaaaattaaactatatttcctaacatacaatagattatatatttggtaacatttatagtattttctgtgttcttaactatttttacattacttattaactttttaactaaaaatactaataaaacataatatgactctacatagatttatcaagaaaagtactactatgtagaatgcatttcatacatcagtaaaaacacatatcaaatattaaagaacttattaaaaaactaattagagattaaagattcaagaaatcttattcattataaattttgctcctatctctatacaagcattacttatgctatgatctaaaccaggaattgcatgactttctaaaggcacattatgatctaacaaaaatccaactgcatcattaaaaaatgagaacggcactacatcatcttctgtaccatgaactatacaaatatcaggttttacatttatattatgtttcaagtaatttggacatattatagcccctgaataagatattacagaagcacattttcttttcctcaacaatgctatatgtactgctaacattgctccttgagaaaacccagctaaaactaacttatcatcactcaatccagtatttttcaattgtaaatctataaaattattcacaatcaaagctgttttttccatatcagcaaatatcacatcttcagaaaaatcacgtccattaaaccatgcataccctgcatctccatacttcatatgagcattaggagctataaagtgagcattaggcaatagttcacccattaaacgtcctactgacagtatactattaccagttgctcctcttccatgaagcaatacaaccaaaacattagcacagtcaccagaagtaaaactaggtccatcaataactatactcataatatctctccctatatattaaacaacttaaatgataggtcactacttactgaacaaaaaacattattgcataaataacagtaatagcatgaccaatacaaaaaatttttgtactatagctacactacaatcaaatcacacaaattaaaatacttatacttacatcacactttaacatacgcatgtaaaatacaaaactaatacaacaatcttactttacccaacataagatattcaaaccattacttatacttattttctactatgcactatacatgtttgtaactctttatcaaactctaacaattttttccattacaatatcttataatacaaaatatacatcaatgacttaaataaccatattattaaatatcattgtaatttttagctatttaccgataatacctcaataaaccataataaaaagcaaccatatcaaaaaccctttatggggaggaaggtttttgtaactctttacaaactttaacaattttttccattacaatatcttataatacaaaacatacatcaatgacattaaataaccataaaataaatattattgtaatttttagctatttacgataatacctcaataaaccataataaaaagcaaccatatcaaaaaccctttacggggaggaaggtttttgtaactctttacaaactttaacaattttttccattacaatatcttataatacaaaacatacatcaatgacattaaataaccataaaataaatatcattgtaatttttagttatttacagataatacctcaataaaccataataaaaagcaaccatatcaaaaaccctttatggtggagaggaaggttttttgtaactctttacaaactttaacaattttttccacattacaataccttataatacaaaacatacatcaatgacattaaataaccataaaataaatatcattgtaatttttagttatttacaagataatatctcaataaaccataccaaaaagcaactatatgaaaaatcctttatggggaggaaggtttactgtatcccccagtgacattatgaaaaagattaatgaatcaatatcgtttgacaaaatactatatgaagaagatatatctgggtcaatagcacactgtaaaatgttagttaaccaaaaaatcattagcaaatatgaaggtcaacttattattcatggactagaagttatacaaaaccaaatttcatctggcacttttgaattcagcacagacctagaagacatacacatgaacatagaacaccacttaaagaaaatgataggtaacattgcaggaaagttgcatactgcaagatctcgtaatgatcaagttgcaacagattttaaactttggatacggaaatcaatagtaaaattagaaacgctattacatgaattacaacagactatacttaatatagctgaagctaattacgatactatcatgccaggatttacacacttacaaattgctcaacctgtaacattaggtcatcatttaatggcatattttgaaatgttaaaaagagactgttcacgctggcaagatttacacaaacgcatgaatcaatgtcctgcaggatctgcagcattagcaggaacatcttttccaatagacagacatttcatcgcacaagaactaaaatttgacagcccaacagaaaattctatagatgcagtatcagacagagactatgttattgaatttttatcaaatgcttcaatatgcataatgcatttatcaaggttagcagaagaaattatactttggtgcagctacaattttaagtttataacactttccgataatatcacaaccggaagttcaataatgccacaaaagaaaaacccagatgcagcagaacttatcagaggaaaaactggaaggatttttgcatcattaaaccaaatattagtcgtcatgaaaggactaccactagcatatagcaaagatatgcaagaagacaaagaacctgtctttgatgcagcaaacaacttaatgttatgtatagaagcaatgaacagcatgttaaacaatattaccattaacaaaagtaatatgctaaaagcagcagagcatgactattcaacagcaacagatcttgcagactggctagtcaaaaatcttaatctttcatttagagaatctcatgaaactactggacaaatagtcaagttagcagagcaaaaccactgtaaactacatgaattaactctagaacaaatgaaaacgatcatcccttctataactgaagacgtcttttcaatattatcggtaaaaaactcagtagacagtagaacgagctatggaggaactgctcctgcaaatgtaatcgaagcaataaaaagaggaaagttatatctcagcaatattactactttacattcagaaaacaatatgtaattttttctagcaatcagtacctattacacatttagagaaaatgcagtacatgtaaactagatatagcaagattactgttttgaagaatactactcctattcatttttatattaaacacatgcaaaccacacctgagtactgaccttatatctctaactaaataattaagtacaagtgccacattcaatatagaagtctatgcaatatcaaatatcataatctaacatagactttatattaaataagaggacctaattaactagatcaataagctatttacagtctatcaccttattaatcttactttgattgtaacacacacatcagtattttattaaatgctatttagcaccgttatcatatgtataatgcatttttaaataattcactgttttctgtgagaatatagcactacttacataaatttcctataaataagaacatcattttttatttacaagtaatatatgtactacactatgatcttcctgagaaatactatgtacacaattattttttatattatctacaacattagctaataatattccatttaagtgatcaagttcatgttgtatacatctagaaagccaaccatagaccctcactatacattcattccctaacaaatctgtatacctcaaatccatatgttttggtcttgtaatattaatcaatccataggatttagcagatgaacatccttcaaataaatcaacagtttcagcagagaagctgagaacttcaggatttatacatatcatatttttaccatgtaatgaatgatgtccagataaaacttttatatcctgtgcaatatcaaataaaccactaaacatatttatgataaacattctactatgattaccaagttgaactgcagataaccctacagtcttactatgttccataaccttcatcatatcattagctaacgctataatttcttgatctatcttttcaatagggtgagatatagcatgcaaattttgtaaatcttgaacattatcaacagataagatattcatattatattcctctcaacttttagtataagcaatttacagtataattctatatatttcattatcttaacagttgttatacacatttattagttatataagtagtatttttataaaaaactgatataatcagtgcatattaagtataaactaaccaccaaatattgtgtcactacaacatatatttaccaatccgctattttgtataccaccagaaattgcacataaactagtaatttttgcactaaagaacaatttcatccccacaaaaaaaattgaaattccaagatctcttaatatacaagtcttcaataagcttctcagaacccctataggggttgctgctggttttgataaaaatgcagaagtaattcaacccttattgtctattgggtttggatttgttgaagtaggaacggtaacaaaacaccctcaaaatggtaataaaaaaccacgtgtacatagattaattagtaaagaagcaataattaacagtctaggctttaataataaggggataaatttcttaataaagaaagtaaataacattcaacttaaccattgtatatttggaattaacataggatttaacaaaaaatccagtgatcctatccaagactatttcgattcagtaaagaaagtatatggtctaagtaattatattacaattaatatatcatctcccaataccccaggattagatgagtttcaaaaaaaagatcttctttcagaattattaacagctatatctcaagttcgaaagctagcagattatgcagaatctgttcctataatgctcaaaatttcaccagacattaatgataacaaaaaacaagatattgtagatttagcaataaaatataaaattagcggtttaataatcagtaacacttcatcacaacataacaaactattaaatatgaatacaaacatacatggaggattaagcggaaaaccactatttgatttatcaacacaagtattgtctgaaatatatcaagcttcccaaggaaaacttttactaataggatgtggtggagtaagtactggatatcatgcatatgaaaaaataaaagctggtgcatcattagtacagttatacactgctatagtttacaatggattcaatatagctaataagataagcttagagttagctgatcttttagccgcagatgggtttcctacagtacgccatgcaataggccataatcactagcaggtttaacatgttaatagcaatagatataggtaatacaaacataaaattagcaatctgtgcaaacaataaaattataaaaaggataactatctcttcacaatctaggagaacagctgatgaatacttcatatatttaaattctacaatgaatcaattaaaccttgattacaaaaatataaataatattatcatatcaagtgtagttccaagtataacaaagccaattatcgaattaagtcaaaattattttaatatagatcccacaattttgagtaaccatcatgcagacatttttaatattaagataagcttacaaaacaaagtattaggatcagataggttagcagatataattgcagcaagcagtttatatccccataaagatttactcataataggtatgggaactgcaacagtatttaacttattaaataaagataaatgcatatatggacaagctatagcacctggagcacatattttagcaaaaagtatgagacaatacactgccctattaccagaagtattaatttcaaaacaagacaaagtaatacatgataatatataccacgcaatggaatcaggaatatactggggatatattaccatgattaacggaatgattgaaaaaataataaaggaagaggaaaaagatttatatataatagcaacaggaggaaattctaacttattctttaatcacaaaactgctattcacaacatcgaagtagacttaaccataaagggtctcatacaattacatactgtactatcttgataccaaaccctgaaataatataactcattgctaactgatatgatatagtacaataactaaaaaggacgaggaaaaagacttatacataatagcaacaggaggaaattctaacttattctttgccacaaaattgctattcacaacatcgaagtagacttaaccataaagggtctcatacaattacatactgtactatcttgataccaaaccctgaaataatataactcattgctaactgatatgatatagtacaataactaaaaaggacgaggaaaaagacttatacataatagcaataggaggaaattcaacttattttttgaccacaaaactgctattcacaacatcgaagtagacttaaccataaaggatcttatgcaattacatactgtattatctggtacaaaatctgagaacaaataactcattgttaacttatatgatgtagtacaataactaaacgttatttttaacaacaccattattataattacattgctgcttagatatatttgcagatatctctttaatcttttcaactacatttgtacttgcatgtaacaatatatccgacaaaatatccttatcaatattattagctattaacattaatgaatctatatccaacaattcaaagacttcagcagccaattctacaggtatactttcatatatttttactaaaccatgcactttttcatcataattttgagtactaatattaatcaatgatactaaattttttttcatctcttctaaatataacatttgatcattattatgctgcccagcaatttttagcaaagcctctttatcttttaaactattttcttgctccaacaagcgataataccaatcctgcaaatctacaacagatataagctcactatttactggaaacaattttattttttgatttgaatctctaaaaaaacaatcatcactttttacaaattccacatcattcaacaaaccaaattccacaattttatcattatcaatgccataaaaattatgtaatacaaccccagttatacagaatattaatatcacattaacaatataaatcacttgcatactattaataaaactattatacaatgccttagaatcaagtatgttataataaaacactattgtgatttagcaataaataattagtagtatttatattgacactgcttatactgcttatatctaaaatactttaagaacataaaattaatgaaggcgtttttcacattgttcatattttggtttgccctatcagggtatcttgatctattttttataacatcaggtattacaagctgtattattacactagtcatagcaagaatgctacagaatgttataccagcaaataagaattacacttactacatatcaaaaaaacaattccttcctttcacatttcactttttacgttattttttttggatcatgcaacaggttgtactgtctaatatacacataataaaaaaaatatggaatttgagtataacaatcaatccaccaatttttagagtaatagaaaccaagcaaattaccggcttaaatatatcaacagttgcaaattctattacacttactcctggcacagtaagtataaatgttacagaatattctagcccatacaaaataacagttttagctatagatgaagagtcaatgtctggtgtaatagatattgataataaaattgcaagtatataaatcttcaataaatactcgtaataatagacaataatatatcctttggtgttcatacaacaatttagtaattgtcatagaaataatctaaagttgtaaattcatattgtcattaaatctgacaagtgattaattttgacatcatgaacacagtgactaacttgctgcatatgactaccctgatctatgttaattgcttgattacacagagctttggtttgtatactttcagtatctctctcaagcacttttttattcattacactttgtaactctagtacatcaaggtcacgagataaaaacttgacttcacaatctatacatgcattactaagtttaaatattctattttctttaatataaaaattacattcatgcgcacataaattactagtgtcaataattccattaataaatacgtgctttattccccttagaaaaaaattacccttagcaatggaagaaaaatataaatacattccaagcataacaactacacaacttcctttatatacatttccccttagtatgacattactacttcttacttcaatattaccataaacattgccacaaacttccactacactgttttcaacttttactattgaagatttttctacattacctgcaatgaaaaccatagatgtatctattccactgtgtttagcttcaatactcccactaactgatccctcaattcttactgaatcacgacacgacaacaatcttcccttcacattaccatatacaaaaacattattacaatgcaaagtcacatgtacaggaatgtcaccttttataattacattactatatttagatgcatctaaccgacaattaccactagcagatttaaaatacttaaacgagacaattaaattatcctttactacaaatgaatcaagattctcttgagtaatactttctaaatcgataaccttaaagacctctcttaacttagcaacactacttacatttatcgtacctatatattgttgtattttacattttacataatccttaccaacacaaaaatatacacccttcatttctcctttatgaaataaagtatgaataggtttcacataagaacctacccagcacatatcttgtagattcttaacatgtaaaagtaaattttgacaattaggcactgaagtaattttgttataatacaaatgatatactgaaataatcattttataatacaaacgacacgactttaaatcgttcataataacagattcacacttatcaaaatttgggttatttattatacagaacaagacccaatgcaataagatactatcatcttgcatagatagtttatctgtaaactttaaaaccgtgctgacagatttacgcaaattatcaaatgtattttttacaaaatcccctaacataacatcattataaattacatacctacagcttaaattactccctttgttaaatatagatctcttcaaacttgaaacacaaccaagtgaaacatcttgtctacttgaacagtcatatgatcttgcataatcaacaagtaaagggcgttctttagaatacaattgagatacacctctaaaagactgtgattttctagtcccactatttgttaacacaacatccgaacttttacattttatatgaccagcaatatcatctgtgacattaatatcttgacaaaccataatattttcaaaacgttgttcaccacttattctagccgaattacttcttcttaaaacaacgtctctacttctactgtagcttcttatattagatctcaaatgcttacttatagtaccatgcaattgttctgatactacagtctcttcaatttccccctgatttctggtattcacataagagataaactcttgtaataaatgcattggcttcaatttaccatccttacaataccttataaaaacaccttcatcatctttcataacaacatcacttaggttactttcaatatcaaataaagacatagtagggaacatatctataagagcatccttacctatttctggaactaataccttaactaatcgatcaataccacccacatcatcaatcaatatttttaacaaatcattcctaccttcttcacttttcatgtactgaaatacttgatgatttacaagcgtacacatcttatcagaaatacaatctctttcactagtcactccatcttgtacaacaaagctactttggatattacttgagatactctgaccgcattctaccttaacatctgaaccaaagtgtaacgttgcagactccaccagctgaccagattcacttgtaatagtaaaatgaccatctattgacgaaaagaaatcaacgttagtttctccactagttgatggaacactcatatcagttattctttgatcaacaacattcacaggtataggcttttttaaaggaacatcatatcttgagccatctgctacactgctagtactattcaatttgtcctttccaaaatgttgactactactatcatcaatttttgaagaatggatattgcattcctcaccacatgatggaacattcataccactcatcttctgatcaacaatattcacaggcataggcatctttaaaggaacatcatatcttgagccatctgctacactactagtactattcaatttatactttccaaaacgttgactactactatcattaatttttgaagaatggatatcgcattcctcaccacatgatggaacatccgtaccactcatcttctgatcaacaacattcacaggtataggctttttcaaaggaatatcatatcttaagccatctgctacactactagtactattcaacttatactttccaaaacgttgactactactatcattaatttttgaagaatggatatcgcattccccaccacatgatggaacatccgtaccactcatcttctgatcaacaacattcacaggtataggctttttcaaaggaatatcatatcttaagccatctgctatacttctgccatctgctacactgctagcactacctgatttattttcctcaaaacattcatcactaccataactaatctctgagaattgagtactatattcttcactcgttagtaccacatgttcaaccgtttcattcatatctatagaatcacacgattctctttctcttgagctagacacactttgataactcatcctagataatctagatctcttttgatttaacatatgatttagaatcaatactttaaccaatctagggtcactaccattctgacatatgcttgattctatggctgaaaattccgactttttttcttcattttccaataatattatattcaacacactatttaaccttttcaatatcctaaacatattatccagagatatttgaaaattatgtatccctacttttacatcgctaaattgttcagaaggaaaatctacagaactcgccataaattgattagaactatgacattgccgttgcaatcttagtaaaatattttgcgtctgtctcattacacataatacagattccatctgtccgcctatcaacaatgtgttaccatcactaacaacaccaagaccaccacccatatcttgctgtttacttacagagcctaccccagtagaagcagtagcactacctgcactttctattgcttgttctgaagaaacagctgcatctgataacaaaatattattaatactaaagtaattcgatacaagatcttcacacaatttacacagcgtatcttcactgattacaatattaggtaccttttccaataaacgcgattgacatccaagaaaaatactcaagtcatattgaagatagctcaagtcataaaaaaaacttgtcatacaagaagagcacaaagtagaaaagaaagccctactatcttctttagacaactgattaataagatcacacatttcaatatatacgtgtcttaccctatcatttaagtcttttataatctctttatgagaaccaaattgaacaaaatatctttttatcatatacggctttcgaccattaaaatcagtaatagtacggcttgttttatcacattgagtagtacattgcgggatagaacgttctctactactatcagtaacacaatattttaacatcagcacaaactcaaattatcaaaaattttactatgataattaatatctttactatttttatacaaaagttccctcatctattttccattaaacaattgtcagctcttacttacacatccgcattaaacttataaaattgattggtaaaaacttacgcaatacaaagctgtgctcaaataaacacaagtatattgaacactacttaattagctcactaaacagtacactacagatcaaaactcttaaaaaagcccttgtcattataaagttagataaagccatagttagaatctagaactaaattatcaacagactctaatatcatccttcaaacaacaaaacagtacattcttcaatattaatcaaaaatatgctaccatatttaaaaaaaccgttatatcaattttctttatacaacattatttacacaaatttttctacctttacactaattaacatataagcatgctattatatgaataagaaaagataatggtcaatataaaaattaatataataagtaaaaatattaatatcactttgtagctttcatttaaactacaactttctataatatgtattaatacataatcctctacctttaaacgctaaaaaactttcttcacaagcaaatctaaagtataaatatactttacaactaatccttactaaaacctaaaataagctttatgccagatttttctatagaaaatgaaatatcaaaattaataaataataaacactgtactatagtaggagttgacgaagtaggatatggttcattagctggccctgtagtatcagctgctgttttttttccaaaacatgacaatcacatcacatacaatattcaagattcaaaaaaactcactccaaaaaaaaggctagaaatttataatataatcactcctatggtaaaatggagtatagggcttgctgaagtgcatgaaattgaccagtataatatactaaatgctacacatattgctatgcaaagggcacttagagggttaaattctaatatagattatgtaatagtagatggaaataaagttccagagctaccatggaatgcaaaagccgttgtagatggagataacataagtatatcaattgcagcagcatctataattgcaaaagtcacacgagataaactaatggaaacactacacatacaattcccacaatacaactggaacaaaaataaagggtatggtactaaacatcatttagagtctttacataagtatggtaaaactatacaccacagaaatacatttgccccagcatcagggataactaaactttacaataaatgataaaaacctcactactattgatttaaaacacactctataaattcacactatactctaaataccacctatttaatcaacactgtataaaagtactcaacttctaatttccttaacaccagctatttataaagttattatacaataagtaagataccctaaatatgataaaaaaagtaatactactagtttcaacatttctactctgaaatatcctgataatacattaactatgcctccccatactggaatccaagaacatagcaatgttaacaacattaaggctaactttatataaacacctaattttccataatcatcctgcactttatgatactccacacgtgcaaaaattatcattctacccaatacccagttaatcacccctcctataactgcacctaacgttgatactaaaagcatcaaaggataactataacccccaaaataagccattattttaaatatcaatattttatttaatggtaaaataagagcagctacaaaactatcaacgaataataaactataaatttctatcatctatagatacactatcacatattccacgggactggtgcgatttgaacgcacggccttcggattaggaatccaacgctctatcctactgagctacagccccaacacactttcaatcatatagattatctatacaatgtaaacaaattttcaactcttcattccaaatccacagcagatatttcatataataggcactttgcacttccttttattttattaatgtcataacacaaattttacagagaattcctaaagtctctttagcatctattattaatattcctaaattatcaacagactctaatattattattcaaataacaaaacaatcctcattccaatattagccaaaaatatgctacgattttaaatctacaaaaatattctatataacatgtaattaaatatgagtaacaccacttaaaccttcttcaatattaatataaacagtaacatgctttacttttaagtgataataaacagatctacttatcactgttatactaagataaatattaatattatattttcatgcaatagcagttgtttaggctaacttatttcattttataacttcacaattaatacaaacataacatgctttactttttaatgataacaaacaggtccacttatcactgttatactaagataaatattaatattatattttcatgcaatagcagttgtttaggctaacttatttcattttataacttcacaattaatacaaagtaacatgctttactttttaatgataataaacaggtccacttatcacttttatactaagataaatactaatattatgttttcatgcaatagcagttgtttaggctaacttatttcgttttataacttcacacaatttctctatatctgataagctatgattcacactaaatacaaatctcagtcttggagtcggtacagtaggaggacgtattgccacaacaagaaaacctgcttcccttaacacttgctgtgcatgtaaaacgctattcatatttttcataattaatggtactatatgactactaggttcagcaagattcagatttttacaaaaaaatttagccaatttaataggtatatcattaacagatgcacttataatatccaacgcagcattcgcagcagcaataaccatcggaggtagagcagtcgtatatataaaagttttagctttattctgtatatactttataacaacctccgatgcacatacatatccacctaaaacaccaactgctttagataaagtaccaatgtatatatctgaattagcacaaggtattaatccaaatccatgagcacaatccacaataagccacgcactatatttttccgccaatttttttaactgatcaattggagcaatatcaccattcatactatacacttgctcaactacaataaaacagtacttatgtaacctcctatatttttttaatatatcttcacaatgtccataatcattatgctcaaacctataatgcttagcagaagaaagtttaataccatctataatagaagaatgtactaatttgtcagaaatgatcatatcatgtctatgcactaaagcagaaataacacctacatttgttaaataaccactactaaatactaaagccatttctgtatgatataactttgctaatttatcttctaagcattgataaaggatattattccctgtaaccatgcgtgaggcaccagcacctacaccataattatttatcgcatttatagctgactcttttaataaaggatgacctattaaccctaaataatcattacaagagaaggaaactaatctctcgttattttgacaaaccaaacaacctacttcagatctagttacagtagaaggttctctatataaattatcaacctttaatttaataagttcttgatttaatatttcatccaacatatgaaaaactccacagcactgtaacttaatatttatcagctacccctattttggacttttgacaaaatacactcaaatacaagttctcactacaaaaaaaccctatcgaaacatagtaagaagtaataatttactttacatatcatccttttaattgagatgcacccacaaacagaaagaaacactaccatataatttacatctcttcacaagaagaagaaccacctctccacccatcaataattaagacttagatgctttaataatcaacaatatttccagtatctttatgcagttcctggttaaaagcattattatcattttggagtaatgctgaatcttgatattcattattataatacatagaatagtcctctttatttaataaagacaacttctttatcttattcattaagaaccctgtacctgcaggtattaatcgacctactattacattctcttttaacccatataaagagtcttccttaccagaaaaggctgcttctgttaatacttttgttgtttcctggaatgacgctgcagaaacaaatgagttagtatcaagactcgctctagtaataccttgaagtattggagcatatttagcaggagatttacccatttttaccatattatcattagtctttattacttcttccatgtctatattttcaccaaccaaatacatagtgtctcctggttcaaatatttcaactttttgcaacatttgtcttaagattatttctatgtgtttattatcaatacgcacaccctgtaacctataaacctgctgaatttcagaaatcatataatttgctaatgcttcaactcctaaaacacgtaatatatcatgaggatcaggatcaccatccattaataaatcccctttatgtacaaaatctccctcatttacaatagtatgcttacctttaggtactaaatactcaacaggtgataaggtatcactgactggcttaataaatatacgtcttttagatctataataatcttttccaaattcaacataaccatcaatatcacttactatagcatgttcttttggacgacgtgcttcaaacaattcaattactcttggtaacccccctgtaatatctctagtttttatagaatctcttggaattcttgttattacatctccagcatgaactttttgtccatcctgaacatttaacactgcccctattggtatgaaataatttgcctccaaaccattggataatgttattatattatcattatcatcaattagaactaacctaggtctgaggttagcaccctgtaaatgtaatttccaatcaactactactctgttagaaataccagtagattcatccaagacttcattgatagacacaccatctattaaatccatatacttaatgatacctgttttttctgtaataataggcattgtatatggatcccactcagcaattttttctgtaatttttactaactgaccatcatcaacataaagtcttgctccataaggtacattatgacgcattttttcattgcctacactatcaagtaacactacttcacaagatctactcatgacaatcttattaccatgcttgtcttcaacgatattactgtttactaactttaccttagcatctaataacgctattaagtttgaagtttcaacacctctcattgcagtaccacctacatggaaagtacgcatagtcaactgtgttccaggttcaccaacagactgagctgctattacaccaacagcttcacctattgatacaacatcaccaatagcaagatctctaccatagcacaaagcacaaatacctttcttcgcttcacaagtaagaggagatctcacttttacagcatctaatcctgctatttttattttttcaactttagcttcatctattaactctccagctttaacaagtaactcttcagtaataggattataaacatcaacagcagcaactcttccaagtattatattatctaatgtttcaactacagtcccaccttcaacaacagaccttattgcaaatccattgtgtgttttacaatcgtactcaacaactatacaatcctgagcaacatcaacaagcctacgagttaaatatccggaattcgcagttttcaaagcggtatctgctaaaccttttcttgctccgtgagtcgaattgaaatattcaaatacattcaacccttcacggaaattagatattataggagtttcaataatttcacctgatggtttagccattaatcctctcattcctgctaattgtttcatctgtgatgcagatcctctagcaccagaatgagccatcatgtaaatggaatttaatttactttctacatcatatacagaaatagctttcatcatatctttagctatcaagtcagtacacttagaccattcatctattactttattgtatctttcacttcttgtaattaaaccatcttgatattgaacagcaaattctttgattttttcactagcattatctacatgcattgtctttgtatctggaataatcatatctttacatccaaatgaaataccagactgcgaagcatatttaaaaccaagagacatcaacttatctgaaaattcaacagtctcactttgaccacaactacgatataccaaatcaactatagatgtaatctcttttacagttaaaacttgatttattaaatcaaaagtcaaatttttatgttgtggaaatatctgccataatatcaacctaccaggagttgtttcaattattttagaataatatgaaggcttcccatccgatgtatcataattacaataagtcattctatacttaatttgactacataaatgcacatctttgttatgtaaagcgtattccacatgactaaaatcaccaaagaataatatctcatcttcagattgaacttgatcttgtaaagttaagtaatatattccaagcactatgtcctttgaaggaacaattattggcttaccattagaaggacttaagatattattagtagacatcattaatatcctagcttcaagttgagcttccaatgataatggaatatgtactgccatttggtcaccatcaaaatcagcattaaaagcactacacactaaaggatgtaattgtattgctttaccttctatcaaaactggatcaaatgcttgtatacctaatctatgcaaagtaggtgctctatttaataatattggatgttcatgtattacttcatctaagatatcccaaacttctggcttttcattttgtatcattttatttgccaattttactgttggcacaataccatacatttttaactttgaacaaataaacggtttaaacaattctaacgccattttcttaggtaatccacattggtgcaattttaagttaggaccaacaactattactgatctaccagaataatctaccctttttcctagcaagttttgtctaaaacgcccttgcttgccctttaacatatcacttaatgatttcttgtaccctacactccctgccttattagaaacatagctacgacgtgtactatcaaaaagagcatctactgcttcttgtagcattctcttttcattacggatcataatcgcaggtggatttaattttaataacttacccaatctattattacggttaataattgtccgataatgatggtttaaatcagaaactgctggtcttccattttctaaagaaacaagtggtcttaaatcaggtggcaaaattggtataactgttaatatcatccactcaggtttgttaccagaatttataaaattctcaacaatacgcaatctttttactattttttttctcttcatttctgaagttgtagattccaactctactctaagatttgcattaattgcatgcaaatccaaccgcactaacaactccctaatagcttcagctccagttaaagcaagaaaactatcttctccataattatcttttgcttgattgtaagcactttcactaataacttcacccttagacaatggagttgcaattggatcaataactacaaaatcaccactatataaaatattttctatcaacttaagcggcatatcaagtaatgcacctatacgcgaaggcagagatttcaaaaaccaaacatgtgctacaggagatacaagttctatatgtcccattctttctctacgcaccttagatgatgtaacttcaactccacacttttcacaaactacgcctctataacgcttttttcgatacttaccgcacaaacattcatcatcattaactggcccaaaaattttaggacaaaaaagacctcccttttccactttaaacgtacggtaattagtagtagaaatatctttaatttcaccatacgacattgctctaatgctttcaggactagctatagatatgcaaatcttatcaaacgattgcgcaatactagtatagccatacaaatccaacatcttcatatactactacctttaattattaatctttcacttcattacttaagaaatccttatcttgctttaaagcaacatctaaacacaatgatcttaactcttttaccattacattaaaggattctggtattccacattcaaaattactatcacccttaatgatagattcataaatcttaactcttccaacaatatcatcagattttactgtaagcatttcttgtaaggtataagcagctccataagcttgcaatgcccaacattccatttctccaaaacgttgaccaccaaaatgagattttccacctaatggttgctgagttaccaacccatatggaccaacagatcttgcatgtattttatcatccactaagtgatgtaactttaacatgtatatgtatcctacagtaaccttacgatcaaatttttcaccaattcttccatcataaagatctacttgccctgaaacatctaaatcagctaatcttaataagttagaaatttgactatcttttggcccttcaaatactggtgcagccataggcacgccatcacgcaatctttctgcaaaaaccaaaagatcctcatcactcatagactgaatattatcttttaaatcttgcccatcatatacttgatataaaaagtttcttaaatgagataccgtcaattcatcaaggttatctaatatatgccctatctttttccctaaattaacagatgcccatcctaaatgcgtctctaaaatctgcccaacattcatacgagaaggtacacccaaagagttcagtataatatcaacaggagtgccatcctctaagtatggcatatcttcaacaggtacaatacgagaaatcacccccttattaccatgtctaccagccattttatctcctggctgtaaattatgttttactgcaacaaaaactttaactatacacaaaacaccttgaggtaaatcatatccatagtttaatttatctatcttttgatcaaacttactatgagcattttgaatcattgaatcaaatttttctttcaagtccttaacttgaagcaacatagcttcatcagataagttaatatcccaccattccttctttggaatagatgctaaataatcatctatattctgattattatactgtacaccagaactcaccaaaactcttttcaattcatcatagaaatactcactaactacatctatttcataatccctttcttttataaaaccattgatttcattttgtttaattaaaagagatctatcattttcttcaacaccacgacgcacaaaaacatgcacatcaactactgtcccttcaacatcaagtggcaaatatagtgaagaatctacacaatcaaatactttttcaccaaaaatagtaactaacaattttgtttctggaggtaaagaaactggtggtctaggtgtcactttaccaaccaaaatatctcctgcagaaacttcagctccaacattaacaattccaacatcatccaaatgagataaactatcctcattgatatcaggaacagacctcataatcttttccggaccaagcgttgtatctctaactacacattcaaattcttctatatgtattgaagtaaatacatctttctttacaacttcacttgaaataactattgaatcttcaaagttatatccctgccaagacataaacgcaaccaacacattcttacccaaagcaagctcaccttgatcaattgctgatccatcagctataacatcatttgcttttacataatctccaggtttaactaaaggtcgctgattaatacaagtattatgattagaacgttggaatttccttaagttataaatatcaacacctaaatattcatttttttcctgatcaaacgcacgaataactatatacagtccatctaccctatgaacaatacctccacgtttagctaaaacaactgttcctgatcctgcagcaactattgattccataccagtaccaatcaaaggagcatctgcttttaataaaggtactgcttgacgttgcatattagaacccattaaggcacggtttgcatcattattctctaagaaaggtattaaagacgcagcaactgaaactatttgctttggagaaacatctatataatcaacttcttccctcttaaccattacaaaatttccatcatgcctacaataaagcatatcatcaacaaactgattattctcatcaagagtagcactagcatcagctatataataattactttcctgcatagctaacaggtattctactttatcagtaacaactcctttatccacttttctataaggactctcaataaacccatgcttattaatacgggcataaatagccaagctactgatcaatccaatattttggccttctggagtttcaattggacaaatccttccataatgtgttggatgtacgtctctaacctcaaaacctgctctttccctagttaaaccacctggacctaaagcagataatctacgtttatgagtaacttcagataatggattagtctgatccataaattgggaaagctgagaagagctaaagaaatctttcaaaacagtagccaaaaccttaggatttacaaaatcacatggcattgcattatcaaaattgaccgaagacatataatccatgatcattctttcaagtcgcaatataccaatcctaaactgattctcaataaactcaccaacagatcttactctacgattaccaagatgatcgatatcatcaacagaaccttcaccatcccgcaataacactaatttctttatgacatgaattatatcatctttagttagtaccgtaatatcttcactaacatttaacccaagatgatcatttaactttattcttccaacagtagataggtcatatctttctttttcaaaaaataacccatcaaaaaaggcttttatagtatctaaactaggtgattcaccagaacgtaaaactttatatatttcaaacagcgcatcttcataagatacatttttatctaaaaataaggtatttaaaatatatggaccaactgttagaaaatctatatttaaaacaaagatttcctctatattaaacaattctagtttgtttatatgctcgctagtaatattttctcctgcagatataattaaagcatttccagttgaatctaataaatcattagcaataaataatccttgaatttcattaaatggaactaaatacttcgtaagcccatcattagctaattttctagccattcttaaagtaattctggtattagctttcaccaatacattaccatctgaatccataagatcatgagataatctaacacccctaaatctatcagcaacaaatggaacaacccatcctttttcagattttacataacgtattttatcatagaaagtatccaaaatatcattattagataaacctaaagctcttaaaagtaaagagactggtagcttcctcttcctatcaatgcgaaaataaagtatatcttttatgtcaaattcaaagtctaaccatgaacctctataaggaataattctggccgaataaattaatttcccagaactataagtttttcctttatcactatcaaaaaatacaccaggagaacgatgcatttgtgatactatcactctttctattccatttatgataaacgtcccatgagaagtcatggtaggaagatctcctatggaaacctcttgctcttttatatattttatactcttttctgatgtttcttcatctactacatattttacttccttgaaagatacttcctgaaccttccatactataaaacgcagaactatacgtataggtacagaaaaagtaatacccctttttatacattcatactcatcatactgtggctcaccaatactataacttacaaactcaagaacagcccgacctaataagtcttgtataggaaacatagattggaaaatattctttattccactttcagtattttgatctatcccaataaatgcattgtatgaatccctctgtatttttattaaatcagttaacgaatcttttatatctattgactttgcataagataatctaggcactgaattaaaagaatttaatacatatttagtagaagttacagaagaagacattaaaatccctcaagattaataaattacaaataaaagctacattaaaaactatttgatactaacttttgctccagcatcttctagctttttcttgatttcttcagcttcttctttcttatactttttaccttctatcaattcttttgcaccttctttttcaacaaattcttttgcttcttttaatcctaaactagtacactctcttactgccttaatcacagaaatcttcttatctgcagcatagctttcaaaaactacagagaaatctgttttttcttctgctgctgcaccaccttcaacttgattaccgcctgcagccggaacagctgttaacaaaccacccttaggaaaccctaacttttgctccatcttttccactaattctgctgctttacataaatctaagctacaaatttgctccaccaaactatctatatcaacagtactcataataattaaccccaatcataaaaaataaaaaagtataaaattaaaacatagtatcactctttattgccaagagcttttaaacacaaagccaatctcaccggaatattataagatatcatactcattatttgtgcatgtaattctcctaaagatggtaaactagcaaagtataaaattttctcactatctaatacctcattgctatcgtatgcacataataaactcaccttgcttttattacttttcataaactttgcaagaatttttgaaattactatgatgtcatctgaataaacaataaatacagaaccaaaaaacttagcagctaactcttctctgttcattttctttaaagcaatacgagataagctatttttgactaccattaaaccactattagccatttttaattcttttcttagagaaaagaaatcatcagctaccataccctgaaaattagcaattataaaatatttaaacttaacaaacaatccttccactttgcttaaatgtaattctttatcgctacgcttcactacttttactccaatattaattatttaaattttctactttaacagactttcccatagttgaaataataaatacatctttaaagtataaaccttttatagatgcaggtttacactgctttactgcactaatcactgcattaaagttttctaacaaatcttctatagaaaatttaatattcccaatttttgcatgaacaataccagtcttatcagatttaaatttaatctgaccagattttatcattttaatagctttagcaagttcaaaagttactgtgttaaatttaggatttggcattaaccctttaggccctagaattttagcaatagaagaaactgatgccataaaatctggagtagtaagacaccaatctacatccaatttacattgctttttcttgacttcttcaatcaactcttcatcacccacaatatcagccatagcttctctagccatttccaagtacccacctttagcaaacactgcaacttttatttctctccctaaccctttaggtagtacaacacatcctctaacttgttcatcagatttcgaactattaatattaagatttattgcaacatctacagattcacaaaaattagctttagcagattctataaccttccttaaacctgactcaacatcataaacttcattactaatcaatgaattcatataacttcctctactacaaccactactactcaattattcttctactacaacaatacccatggaagatgctgtaccgataaccattttcgctgcagcttctacagtatcagcattcatatcagacatcttgcgcttagctatttcataaacagctgacattttaattttcccaacattgtcttttccaggatttactgaacctttatcaatcgcagcagccttttttaataaataagacacaggagaatcgcttattgtaaaactgtaagacttatcattataaatagatatcctagcagtgactagatcaccaactttatattgcttaccttcaccacttgtaatatcattaaactctttacaaaacttaggcattggtataccacgaggtcctaaaacagaagctattttaggtccaggattagctttcccagcttctatcatcaaatttatcttagatactaaaacagcactcacgattatccctccactttttgtatatgctctaacttaaattctatcttagtcagtctaccaaatatcatcacactgactcccgctattttcttatcatcattaatatattcaactttaccattgaaatcttgaaataatccatcattaattacaacttcatcaccaatttcaaaattaacaacactagtatcatctactacactttgacacattttcttacgcatagactccatttcattttctgaaataactttaggaacaccaaaatcgttatttaaaaaattcaataccctaggtatactcctaataaaattcattgaattttcatgtaaactcatatacaaaaacacataccctggcgacaacttcctttttaccaatacctttttattatgttttacccgagtaatttcttcatatgggataaacacttcacggaaactctcttccaagcctaatacccgagaattttccaaaatagtttgacaaactttctcttcgctaccagatgatacctgaataatgtaccattcatatttcataaattaccccaagtactatctttatcaacttcaaaaataaaaaatccacacaacaaaacaaaacagacataaaagtaattattaatattactataaataaaaaccctataacctcatttttagaagcccaagaaacttgtaaagcttcctgttttaccccaagtaaaaacttagcaatattattcattatcagactacctacatgtcatatcactaaaactaaacggcaggagtgataggaatcgaacccataaccttcagttttggagactgacgctctagccaattgagctacactcctattaaacatcaatatatcactactccaaaatttcagtaataataccagagcctacagttctaccaccttcacgaattgcaaatctcaatcctttatcaatagcaacaggcttatctaaacttacttcgatacttatattatccccaggcattaccatctctaccccctcaggtaattttatactacctgttacatcagttgttctaacataaaattgtggctgataatttgagaaaaacggtgtatgccttcctccctcttctttctttaatatatatacctctgctttaaatttcttatacgaatgtatttgaccaggcgcactcaatacttgccctctctctacatcctctttctttattcctcttaacaatatacctgcattatcccctgcttctcctgcatctaatgctttatgaaacatttcaacacctgtacatactgtgctctgtatatctcgtaaccctactatctctattttatctcctactctaattactcctctctctattcttcctgttactactgtacctcttccaggtattgaaaatacatcttctattgacattaaaaatggcttatctttttctcttgttggtaaacttattttttctaaggcattcatcaattccattattttttcactccagactcctgaacctgtttcttcttccaatgccttaactgcagatcctcttacaacatctatatcatctcctggatatccatattttgataataattctcttatttccatctcaactaatgacaacatttcttcatcatctacaacatcacacttattcatccatactactatatcttttactccaacttgttttgctaatagtatatgttctcttgtttgtggcattgctccatctgttgcagatactactaatattgctgcatccatttgtgcagcacctgttatcatattttttatataatcagcatgtcctggacaatctacatgcgcataatgtctattctctgtttcatattctacatgtgctgttgaaatggttattcctcttgctttctcttctggtgctttatctatttcgtcatactttacacttttattaccttctccactcaacctcttcgctaacactgttgttaacgctgctgttaatgttgtcttaccatgatcaacatgccctattgtccctacatttatatgtggtttcctttcttctaccataacattacacctattatttagtttttatctcgtttgccactatattatcaggtacttgttcataacaagaaaaatacatgctatattgtgctctaccctgagacatagagcgcaaatctttaacataaccaaacatttttgccaaaggaataaatgctaatattactttagtattgtgacgatcttgcatttcagcaaccctacctctcctactattaatatcacctataacatcccccatgtactcatcaggagttattatctcaactttcataataggttcaagtaatattgcaccagctttgttcaccatatctctaaaagcaccttttgcagctaactcaaatgctaatggactagaatctacttcatgaaatgcaccatcaactaatgttgctttaaaatcaataacaggaaaccctgctaacataccacttcctctaatattttctaacccattttgaacacctggtatatattctttaggtattgcaccaccagtaattttactttcaaattggaaaccagaaccaggaggtaatggttcaaataatatattcacctttgcaaactgcccagcaccacctgtttgctttttatgaatatattcaatttcaacagatttagtaatagtttctctgtaagcaacttgcggagcacctatattagcttcaacattaaactcacgacgcattctatctacaataacttcaagatgcaattcacccattcctttcaagatagtttgtccactttcaggatttacacacataccaagtgatggatcttctgcaactaatctacttaaagctatacccattttttcttgatccgctgtagattttggttctactgcaatctccataactggttcaggaaattccatgcgctctaaaattataggttggtctaaagtacataatgtatcaccagttaccgtctttttaagcccagctaaagcaacaatatcaccagcttttgcttcagtgatatcctctctattgttagcatgcattaataaaattctacctatagattctgtagaatttttaactgcattcagtactgtagtcttacttgataaccttcctgagtaaattcttataaaagtcaaactaccaacaaatttatcagtcattactttaaaagctaacgcaacaaatttaccatcaatagaagacttaatgtttatagtattagaagtctttacatcgagagcttccatcataggaatatcattaggcgcaggcaaaaaatcaacaacagcatctagtaatggctgtactcccctgtttttaaacgcagaaccacacaaaacaggtacaaattttgactgaattactcctgcacgaatacaacttttcaataaagaaacagatatttccttaccttcaaaatacaaattcattgcttcatcattaagctcaactgcactttccagaagcttatttctatattcttgagctttatcaagcatatctttagggatttctccataatgaaaacttgctcctagagaatcttcatcccatataattgatctcatctccaataaatcaacaacaccaacaaaatctttctcaattcctattggtaattgcaatactaatggagtagcacccagacgttcaacaaccatatcaacacaccgataaaagtctgctcccatcctatccattttattcataaaacaaattctgggtacattatatttatcagcttgacgccacactgtttctgattgaggttcaacacccgcaactccatcaaagacagcaacagcaccatctaaaacacgtaaagacctttctacctctatagtaaaatcaacatgaccaggagtatcaataatgttaatcctatgaccattccaaaaacatgtagtagctgcagaagttattgtaattcctctctccttttcttgctccatccaatccatagatgcagcaccttcatgaacctcaccaattctattttgttttccagtataaaaaagtatacgctcagttgtagtagtcttcccggcatctatatgcgccataatccctatattcctacacttagataactcgttatctatgctcacaaacttatctccaaaaattaatattaattaaagcgaaaatgagaaaacgctttatttgcttctgccatcttatacttctcttccctcattttatacgcaccaccacgtttattataagcttctaacaattcattacacaaacaatccatatacatcttattactacgtttccttgctgctgctgctgctttaaaaatccaacgcaaagctaatgaaactgccctatcttcctttacttcaacaggaacttgatatgttacaccacctattctacgagaacgcacctccatttgcggcattacattgtttagagcagcactaaaaattgacatagcactttcaccaagacgagactccgctttgctcaaagctccgtatactattttctcagctatagatctttcaccagaccgcataataacattaatgaaacgtgctaataatacactattatactttgaatcgggagaaataacccttttagttgccctacgacgacgagacatacattaccacattaattaacttttcttcacaccatactttgagcgcgccttcttcctattttgcactcctctagaatccaatgctccacgtataatatgatatcgaaccccaggtaaatcttttacacgcccacctctaattaagataactgaatgctcctgtaaattatgcccctcaccaggtatataagctataacctcactaccataaccagcaatttttacacgcgcaactttacgcaaagctgagtttggcttcttaggagtagtagtatatacttttacacacactgctcttttttgcggattatgttgaagtgcaggcgccttatttaatgaagaacgagattttcgcggtttgcggactaattgatttattgttggcataatgtaataaccttacagtttattataaaaacagacacaagtagcaccatgtatcttaacttaatggaagcatgcgttacttataaaagaatcatgaaccttagtcaatagaaatttaacgatttttcaaaaactaataagcttaataatacaaaatattatcaacaactcaagtattctttataaatatactattaaaaattatttgcaacctatatttattctttcctatgttttaaacaatatagaaatacttcctttcaaaataatctattatgacttagtataaaattgcctgactttttcaccagacgaattataaaacgtaaccataacattatctacatcttttgactcttgtatttcaactatcgtaaaaccaaaacctaagtcactttttactgtatttgcaactacatctcccatttcaacatcctcaaacaataacatatctttaggaacagcatgaagcagagctccactattaccaactattatttgcataggtatatgtttttgcttcttagattttaaatctagtacctgagataaatgcacatgccctgataaaatcacagaaacattatcaggaaacaaatcaccaaaagcttcttgctgagctagattaccataataaagattccctgctttacctttcaaaacagcatatgaccacacaggacgatgtgttaaaaaccataccgaagaagacttactctttaacaaaggtaagaattgcttttttaaatgttcaatatctgaatcaagaacatttttttcattgccaaaagatgaatcaaaaatataaaaatctatattcttactgtctaactctctagcattaaactcccatgagtctgtaaaattttgacacctatctgaagaagaggaatattgataagggtctaaatacctaaaccatcccatatatgatctatcacaattttcatgattaccccgaacaaataaaaatggagccttaccagacaataacattgatggatctaaccaatcagctttccatgtttcactattatctccataaacattaccacatctttcgacatcaatacattgaactgctctatacaaataatcaccaacatgaattaccaaatcaggattatgtgcactgatgttagataaaatcttttttaaaggccactcttctgaagacatacaatgctgctgactcaatcttgtaccccacaatgacactatacatccagtatctcctataactgctattttcctaatctttctacttataacaggaagatccacattatcaatagatatcagactagttgtttgaggcactaacaattcacaaactttatcattaaaaactcctttttgtggaaatgctctaacactcatttccaattcttgatcatctacgtttactataggacactgttcatcctctaaaacaatagctctaacactcaactgattattatttacaacctgagaccaagtaaataatggcttagcattagcaggtatagataataaaatcaaacatataaaaagatatttcattttaattggaacaaatttcacttacgcaacctcaaataatgacatagatggttgagtataaatctcacctacaataaaattaacagcttcacatttagtaaatctagtattcatgttatcagtaaagttactgcatataccacaaactgcagttaaaaacctaacagaaaaatacaaacctgccaaagatataccaaccattaatattgcactatatatatccggcaataacggtttgttaacatgtttagacaataacaaaaagacacaagtcataacacaagtagtagcaaacagtacattacttatatatctaactattgttatgccattaattctcccactatctcttgtattttgtacaaaatgggaatgatcactaccttctaatggttgtacatcatgatttttagattccacaatacaatcaataagcttaacaaaaaataacattaaaaataacattgctgatacgctgattaaacaatcagatgctacatctaggttattccctatagcatcataatgcttcaatagaagcaagattgctcctatagtatatattaacaaacaagtcatacgtatttgctctaatacactagcaagttttttgtttttaatccgtaaacacattaatatattccctgaaaaattactgaccccaaatattttttagtgtaattaataactcaaacacacaatacttcaatcacaattattacttttttactaatataacttgctaataattaactgttttgtcccataaaacatatatataccaatatttaattattctaatgctttcctttaaacaataaataagatatgctgttatttaagtttttacaacgtacttaataaatgaatactgatgatttattgttcacacccttaggcggagtcggacaaataggcatgaatgtcaatttatatcacttaaatggtaaatggataattattgatttcggagcaggatttgctgatgacaatatgccaggaatagacatgattgttgctgatattagttttatcaaaaaaaatagaaaaaacttgcttggtatagtattaacacatgctcatgaagatcacataggaggcatacaatatctgtggaacgatttgcaatgcccaatatatgcaacaaaattcacagctgccttattacaagcaaaattgaaagaatatccatttagaatcaatattacagaaatcgacatcacaaaaaaattaaatcttggcccttttactcttgagtttataaatttgacacactccataccagaaatgaatgcaattgcattacacactgaaaaaggaatagtagtacatacaggagattggaagttagatgacaacccaattattggtcctgtatcaaatacacaaagattaaaagaattaggagacgaaggggttttagcacttgtatgtgattcaacaaatatatttactaaaaataaatcaggatctgagagtgatttagaaaaaagtatatttaatataataaaaaactgtaatcaaaaagttgcagtatctttatttgcatctaatattgcacgaatctataccatagtaaacattgcaacaaaattaggtagaaaagtagcaatactgggaaaatctcttataagaattatacaagctgcacaagacagtgggtatttgcaagatataccagagttcatcaatatcaatcaagcaaataaactcccaaatgatcaagtcttgcttctttgtactggttgccaaggtgaagagctagcagcaactgccaaacttgctaataattctcatccattcactaaattagataatggagatactattatcttctcttccaagatcattccaggaaatgagaaacggatatatagtgtattcaacaaattcgttaacatgggagttaatgttattacagaatttatggaacatgtacacgtatcagggcacccttcaaaaagtgaagtatctactatgtattcattagtaaggcctaaattatccatccctgtacatggagaatacatacatatgcacgaacatgcaaaagttgcaaaacaatgcaacgtagaaaaagcgataatagttcacccaggagatgtaataagcctcacaaaaaaacaaaaaattaactctgtcaaagctggatactttggagttgatggcaatttcttacaccatcccaaaggcaatgtcatatctatgcgaaaaaagatgagagacgcagggataattataataacactagttttaaacaacaaaaaagaattattaaaagaaccaaggatttttgctccaggagtgctagatcattctaatagtcaagcaattctcaaaaaagtctcatctaaaataagtagcgagctttattctagaaaaataaacaacatacgacaatacgtagaaaatacagttttcaatgctttaaaatatgacatcaaaaacaaaccatttattgaagtacagctagaatacataaattagtacctttatcatttatacaatagaatacttatattgataatctattgtaattaaatattcctaccataacatagaacaatatctatctatataattaactacaacatgcataattagaaagctattacaacttatttactgataataactagcatttcataaaacaagatcattttttatataataattaagataatctattagctatcacaacaatttttaatataataatagtgtttattagctaataagtattgtcttagcatcataatcaatataaattctaaacttgtcacaacaattttaacgttgtatatgtacaatgtatttttttcaattaaatataatggataatcaatcatctataataaaagcaacaatagcattaataccatttcatggggtatcggatgatacactattaaaagcgtgtattgatcttaacttaagtgaagaattttgtaaatttcataacggtatatacgatgtattaaacagtataaatgagaatttgattaactttataaatacgaaatttcatgagacagaaaatataaacaatttaaaaatacgtgaaaaagtacaacatgcagtgtacctgtgcttaacatattatatgtctttaccaaattaccgagaattgttaaaaagcatattatctgcaacatcatataacatgtgtttcttttctaaatctttatataaattagtagatcacatttggtatttaattggtgatcaatcaactgactttaattattataccaaaagaactacactagctgttgtatatacaagtactattatgtattttatcaatgatttttctcataatcattctgatactattctttttttagaaagacgtattaataacgtcatacagatacataaattaaagtcatatatagctaataagacagaaaaatttaatatattcaaagtcaaatttgatgatgaataaagaaaagttatattataacagattttaccaatcaaatactgtcagcattaataatgcaactgttatattttcaatgcagcaaagtacaaaaattttactcaaaccaaatactaaaaaaatcaaatatcactattgataaaactatagttttatcaataaaattaatcacaaaccgtaactattattagtagtgtaacattatattttgctataaaaaccaaccatatctttaagcttatcaatctcaataggcagttgtaattagagaaaaatactaagataaaacaataaaaaattaatttagaaatattatacaacagataatattataaaaatcccatacactaaacataaaatattggaacaagtaaagatattttaagatatttatctgataaatagtgcattataatatttaccaaatatgctataaattaaatgttacacttattatattatacactatgtatcaaaaactcaaaaatctcataaaagtagggttttcactaccaaaacttttaggacataacacactacatctagaagatagtgaagaaaaatcaagatcaagcatactaactaaatcactgtttattatagacaacataataaactttttatttaagtacaacagaaaggattcagtaaatgaggtattgaaaatatcatggggtccgctattcactggatttatcattattttactcttttttggcatatttggaatatggtctgcagtagcaccactcgatggatcagtaattgcacaaggagaagttattccttcatcagaaaaacaaataatccaacatttagaaggtggcatcattaataagatcctagtcaaggaaggagaattagtacaaaaaaatcagcctataatatctttacataatactacagctaaagccaatctagacattataaaagaacgagtacttgatctattagcaacagaggctaggttagttgctataaaatacaattatgaatctctaatctttccagacactctaaaaaatctatcagatgaaaaaacaagaatacaaataataaaaaatcagcaacagttatttgagtcgcacaagaagaacgtatccggacaaatagatattttacaacaacgtataaaacagctacaccaagaattatccgggttatctgctcaactaacttcagcaatcactcaacataaattaattaatgaagaattagaaacaaaaaaaagcctgttagagaatggatatattagcaaaccatatattattgcacttgaacgtcaatatgctgaatccaaagggaaaataggacaaattaaatctgctattgcatcagtaaatcaaaaaattggagaaaataaattagaaataattaatattaccaacaatgtgcaaaataaaatcaatcttgaacttaaagatgtaacatctgccataacagacctaaaagaaaagatgaaaactgctcaagacatattggatagaactataataaggtctcctcaagccggcatcataacaggattaaaataccacacagaaggtggagtaatacctcctggagctcccataacaaacgttgtaccactaaatgacgatttaattatagatgcaaaaatacaaacaaggcatattgaagaaattctatctgcacaaatgaaagataaaaatatagtatcatatgagaactatcatggattaaaagcaaaagtacgcctaagtgcatataacatacgtaaaattggattagtaaatggaatagtagtacaagtatcagctgatgctttaagtgaagtcaatggaatgcgttactataaaatacaagtaataataccaaaagaacaatctgcaaagctaaaaaatttaaaattgtatcctggaatgccagcagaagtttttataattactcaatctcgcactttgtttaactatctgttcactccaataactagtacttttgaaaaagcttttaatgaaagataaaattggattagtaaatggaatagtagtacagtatcagctgatgctttaagcgaagttaattggaatacgttaccataaaatacaagtaataataccaagaaaacctgcaagctaaaaaatttaaaattgtatcctggaatgctaacagaagtttttataattactcagtctcgcactttgtttaactatgtattcactccaataactagtacttttgaaaaagcttttaatgaaagataaaattggattagtaaatggaatagtagtacagtatcagctgatgctttaagtgaagttaattggaatacgttaccataaaatacaagtaataataccaagaaaacctgcaagctaaaaaatttaaaattgtatcctggaatgctagcagaagtttttataattactcagtctcgcactttgtttaactatctgttcactccaataactagtacttttgaaaaagctttcaataaaagataaaaacaaccaaatctaagattacatagaatacaataaatgtatttcatataatgctaatctatggaacacatttaagtataattcaaaaagggaaaagcattatgaaaacaataggaaatattatttatacttatatttaatgtaaactcatagaaaatccacaaacatacaataagttacttaaaaataacttaaatgtttcaattgcgataaatagatttttgatacttataatatttagaaaatagaaattacacttttgcatatctatgataacacaaagctatataatacacattacctatacaagcttttccatacttataacaatgagcacactctacacatcactgatattagtataactacttacacaagcatcctccacaatcagaatttacatctgccagacaattatatatctaagataatattaaaccatatcacaataaaccattaaatactatttacaacatgattttatatttagacttatcatattgaaacattctacataatataactactgatatcagtccaataagcactataactagagcatatggagctgcatcagtatatctttcatcactgataagctcatacatcctggtagccatagtatcaaagttaaaaggcctaataattaatgttgctgcaagttcttttatcacatcaacaaataccaataaaaatccaactagtatactctttttaatcatcggaatatgaacattaaaacatgtagaaactatactatgccccatcaataaagacgaccaatctatttctttcggaattttatttaatccagattctataggacctaaagatacagcaagaaatctaaaaacataagcatatattaacccaaatgttgtcccaatcagagcaaatgaaaaatatgagttcacaaaatgcgatatatttccaagtaataccataacactgacagcaacaatggtattgggaatagcataacccatcacaataaattttattgcataagacaacgattccctttttctgatgatatacgacataacaattgatatcacaatagcaataacagctgttataaatgctatactaacactattgaatacagacatataaaatcgattattaagtgccaatgttcctattttttgaacagtccaatataataaaggaactacaggtattacaaatcctattaacactggcaataaacacacacaatatattagtataagtttcaacttactcttaacttgccaagtatgataatattccgtattcatctttattgttgaatacgatatacctttcccacgaaataatttttccaatatgataagcaaaaatataaaaaacaatgcaataaaagcaaataaacaagcagaatacttatcatgcaataaaaaccaatttctatatattcctctagtaaaagtatcgattgcaagaaactgtggtgtaccaaaatcagatattacttccattaatacaaatgatacactaacagcaatagctggacgtactacaggtaaagcaatagaagttaaaattttatacctagaagaacataacgtagtagcaactgcaacagtactacgaatagctattagacctgttctaactaacatatatacataaggatatagattaaatcctataataataattccccattccaaagatttaatactagggaaataataatcacctttactccaatgaaaggtctctcgtaaaaaaacctgtaaaggacctgaaaactcaaaaatatttacataaacatatgcaactatatatcctggtattgaaagcggtaaaaaaagagctatttcaaaaaatttacgtccaaaaaatgaataataagttacaaaccaagctgttgataccccaataataagtgctattattcctactcctaacatcaaaataatagtattaaaagcatattcaggtaaaacagatgttagtaaatccatcgtcttattctcagtaaatataatagaaaccaatgaaaatattggtgctataaacatgccaactaatatacagagaaaaacgttcttcgaaaggtttgcaaacgacactatatttgagaattaattactacccagtcctatgtttattatacataaacaatctttacagtcacttaaaaccttgcaaaatattttattgataaaatttccccatatgtgatatataagggcttaaatattcgactaagtattttatgattgaagaaaagataggaaaaaagtatcagtatcatgtttctctaaggataatgcattggttaactggcataccaatcatactgatgctgattatgggtttttgcttaaaaatggagatcttccctagtcattatccaataggacagctgtataccatacataaagcaatcgggatggtactattgttttttttaacattacgcataatatgcagatttaattcaattactccatcttatcctaaaagcttctcatatttcttgacggtagtatctaaaattacacatacaagcttatatattaccgctataggaatggccacttctggctatgtcatgtcttcagcttcaggaagagcaataaaaatcttttcatgtaatattccactattaattgatactaataaacatatagctaatgtcgctcagcaatgccacaatatatgtgcgtatatattgtccgctttaataattgtgcatatattagcagcactaaagcacaagtttatagataaagataatgtttttaatcgtataatataatcagagtcgtcatgctatcagaattatggaaagtaggcatagagtttttaggaagtaaatttgccattatgggtggagcaatgagttgggtctcagatccttacttagtatctgcaatatcaaatgccggaggtttcggtgttttagcatgcggttctattagtccagaagaattaagaaaagaaatagaacttactcaacaattaacaaacaatgcgtttggagtaaatctaattataatgcaccctattcttaatgaattaatcgaggtatgcattgaaaaaaacattacacacatagtattagctggtggtatacctaatagtaaaattataagccatattaaaaatgcaaaaattaaagtgatgtgctttgcatcatctttgtcaattgcaaaaagattagtaagaataggagtagacgcattaatagtagaggggatggaagcaggtggacacataggccctgtaagtacctctgtacttgcacaagaaatattaccctactttaggcaagaagaatctcttaaaaaagtacccatttttattgctggaggcattggaaggggtgaaatgatagcacactatctaataatgggagccagtggatgtcaaattggcacgctttttgtatgcacacatgaatcacgtgtacacaaaaactttaaggaaatctttattaaatcctcttctagagatgcaatatcatcttcacaattgagcaaagatttttcagtgataccagtaagagctatagaaaatgatgctagcatgaagtttttagaactacaaaaagacgtaatcagtttataccatcaaggaaaaatttcaaaagaagatggtcaacttactatagaaaaattttgggctggagcattacgcaaagcggtaatagatggagatattactaatgggtctcttatggctggacaaagtgtaggtatggtacatgaaatacaaactactgaacaggtaatccaaagtcttatactacaagcctgcaattatataacttcagtacaaaaaattaaccaacatcaaactattgcatgtacataagtaaataatgtcacacttcatataacctgatacaagatcataaatttactgagttaagtaccaaataagcttctttctagagagtttacttcatactatttcataatttctcacataaaaagcatagcaggaaatctcatgtaaacgtgaaatactatattcttttttaaataccaatacaattgaatacaaaaaaacttttacaacttattatgtttatcttaaaaccttattttaagattccttatgtcacaaaataacaaaaatactatttacaaaatacaccacaatttcatcaaataaaaaaaactatacactttattatactacagtagatataccataaaagattttaagtaacttgacataatattaccttggtatagcatatgattcagtattttatattaaaatttattatgtattggagcataaaatgaaagttatcaaatttatacttaatatctgtttattatttgcagcaatttttctaggatattcctacgtaacaaaacaaggcatttttcaagtaagagatcataacactcccaatacaaatatatcaaataaagccagcattactactagtttttcgttagtaaatcaagatggaaatacagtaaatagtcaagattttttgggaaaatacatgctagttttatttggattttcttcatgtaaaagcatctgccctgctgaattaggaatagcatctgaagttctctcacagcttggtaatgacacagacaagttacaagtaattttcattacaattgatccaacaaatgatactgtacaaaaattaaaaacatttcatgaacattttgatcctagaattcaaatgctaacaggcagtgcagaagatattgaaaaaataataaaaaattacaaaatatatgttggacaagcagataaagataatcaaattgatcactctgccataatgtacattatcgataaaaaaggagaatacatttcacacttttctccagatttaaaatcaacagaaaatcaagtagataagttactatctataataaaacaatatctctaatttaataattaattaaagagaatagtacacactcttatataaattcatggatatatgtgatgggtagatttcttttggtgtttctatcgctaattacattagcatttaattccagcgcacaacaaatacgagttgttggatcatctacagcattcccatttatttcagctatagcagaagaatttggaagattttcagattacggcacccctattatagaatcagtaggtagcggaatgggattcagcatgttttgtcaaggtgtagggaaaaatactccagatatagtaatgtcatcaagaaaaattaaggatgcagaagttaaattatgtcaaagtaataatattaacaatattatagagatcattataggttatgatggcatagttatagcaaattccaaagatagtgccaaacttgattttacaaaaaaagacctattcaaagctttaagtaaatactccacatcaaatgagtatgttgaaacaataccgtccaacaacttcagatattggtctgaaatcaataatagattccctaatattgatattgagatctatggaccatataaaaatactggaacctataacatactagtagaagagatcatgcaagatgcttgtatgaataaccaaaattttatcgatgtatactcagatcctacaaaaaggcgtcgtatatgtagtattatgcgtaacgatggcaaatacattgaagttgctgccaacgaaaacattattatacaaaaaatagcaaaaaatcaagacgcttttggcatattaagttttagtttcttagtaaaaaatcaagataaaatacatgcaaataaaatagcaggtatagaacctaattatgaaactatatcttcaggaaaatacattctgtcaagacccatatacctatatataaaacaagaacacatcagtttttctcccagcttgaaagaatttattaaggtaattctaagagaagattccatcggcaagaacggatacttaattgggctaggttttatacctttatcagataaagacttacaagacactaaaaatcgtattaccggtatattagaaaaataatagcacatatcataaacataaccttatttataataatatatacttttagtatttttataatcataatttcttaaaaagaatttgacataattaatttgttgttggtatcattattgctcgatttatctatataggaggactttctttggttgaagttatagtttaccatggagatatagaacaaggtatacgtacccttaaaaagaagttacaacgtgagggaaaacctaggcagatgaaaattactcaccatgagaaaccatcagaaaaacgtgcaagaaaaaaggatgattgtgaaagaagaagaaaaaaattgcacaaggtgccttacgaaccgcagtttactaagtttcaagttagtgctagacattttcaggtgaagaggccttctcaagctgataatagcactagtgaatgagcataaatttatactatagctcatctatatttttaatcagtagtcagagttcaagtaaggtgtattaatatgaatattcatgagtatcaggcaaagcatatactgagcaagtttggtgtaaacgttccgaaaggggttgtagtacattcattaggcgaagttgatggtgctctcagtcagttaaattcaaaggtagtcgttgtaaaagctcaaatccatgctggtggtagaggaaaagctggaggagttgtagtatctcgtacattagatgaaaccaaaacgtctataaagaatatgttaggatcaactctgattactcatcagacctcaaaagatggacagaaagtaagaaaagtatatttagaagaaggatgcaacatcaagaaagaatattatataagtgccattgtaaatcgtaaacaaggtcaggtaagtataatattttcaactgaaggtggtgttgacatagaagaagtagctgcaacttctccagaaaaagttattgtatgcaacatcaacccagtatttggattccaaggttttcatggacgcaatttatgctttgacagtaatttaagtttagatcaaacaagaaaaatttctgatatagctgggaaaatatataaagctgtgttaagcactgatgctaaccagatagaaattaatcctctagtagaaacatcatcaggggaattcattgctcttgatgcaaaaataaacttcgatgacaatgcactatatcgtcatcctgatattcaagaattacgtgactatgatgaagagatcaaagaagaaatagaagcttcaaaacatggtttaagctatataaagatggatggtaatattggatgtatggtaaatggtgcaggccttgctatggcaactatggacattataaaatattacggtgctgaacctgcaaatttcttagatgtaggtggaggagcaagtcaaaaaactgttactgaagcattcaagattattcttgcagatgataaggttaatgggatactagttaacatatttggtggtataatgcgttgtgatataattgccaacggtattattgctgccatacaagaaattggtataaatgttccactagttgtaaggttatctggaacaaattttgaattaggaaaaaagttactagatgattcaaatctaaatattattacagcaaacgatttaagtgaagcagcatacaatatagttaatatagtaagaaaatagaggcgatatgtccgttttagtaaatagcaacacaaaagttatatgccagggatttactggtgctcatggtacatttcattcagaacaagctattgcttatggaacaaacatggtaggtggagtaactcctggaaaaggtggaacatatcatctaaacctaccagtgtttaatactgtaaagcaagccaaactagaggcaaaagctaatgctactgttatttatgttccagctccttacgcagcagatgcaatactagaagcaattgaagctgagatagaacttattgtttgcattacagaaggtatacctaccctagatatggtacaggtaaaacatgctttactcaactcatcaagtacattaataggaccaaactgtcctggaattatcaccccagaagaatgcaaaattggtattatgcctggatatatacataaacgtggtcacataggtattgtttcacgttctggaacactcacatatgaagcagtagcacaaaccacagaagtggggttaggacaatcaacatgtattggtataggtggagatcctatccatggaatgtcttttacagattgcattagactatttataaatgatccagatacacatggtattatcatgattggagagattggaggatcagaagaagaagaagctgcagaatttatcaaattatcaggaactaacaaacctgtagttggcttcatcgctggcaagactgcacccccaggaaaacgtatgggacacgctggagcgatttcttcaggtacctcaggtagtgctgaaagcaaaatagaagctatgaaaaatgcaggtattattattgctgaaactccagcagtcataggcaaaacaatgttagaagctatgaataataaacgctaaacactttaactaatgattgattagttcatattttttaggggctactttcacattaatgttgtttgtgttctacattttagcactttaatatcaacacattgttttcatacttttatgccattttaaaactacaatgaggtttctacacttacaatcatcggtttatatacacttacccaccacgaaaattatagacacattatcacatagataacactgctttcacattaatgttgtttgtgtctacattttagcattttaatatcaacatattgtttcatacctttgtgtcatcctaaagctataatgaggttttacacttcataatcatcgtttatatacgctgaccatcatagaacactatagacacatacttcgtataaataactaagttataaatccattcctacatcatagaaaacgttacaaatatttatatgcaagtacggcactatatttactgtatttgaatctgaatatttaaagttctacaaatctgcttataaaactgagttataaaaacatattaaaaatttgtattacttaattactaagaatatcaaccaatttactctttacattagacataatatctatctccttaacatattctccattaatttgagctaattgagcatttcctccacctttactttttaccattgtacctatcatttttacaaaatctacagccttaactttacaatgcaagctattgccaactcctacaacacacacaacattttggcccacaacattagcaaacaatataattctatctgcagtaagatgcttattaataaattttctcatcacattaacaggtatgttactcaaattgctgtataagaaatcgacattccctattttttcagtattaacaccttgtagattaatcatatcaaaataaacatcagacaatttttgttctagttcctgatttttcttatcaagcttatctatttgtaccaatacattatctacaggaaccttaacactttcagcgattgaatttaacattttctcttgttgcctaaaataatctattgcatatcgacctgtaacagcttctattctacgtattccacaagcaatactagcttctgatactattttgaaacaccctatctcactagtatattttacatgagtaccacaacataattcttttgaatcttttatactaactactcgaactccatgttcttcatatttttcagtaaataacgcaacagctcctccggcaactgcatcttttaagtcacatacatgactaataacaggattatttccagatattaaagaatacattttatcttcaattaaagtaagctgttcttttgtcaatgccacaccataactaaaatcaaaccttaacttttcatcacttaccaatgatcctttttgcatgatactactatctatttccgattttaaaacgtaatgtaataaatgtgttgctgaatgattagcacataaatttcttctcctttcacaatcaatttttgcaaaaattacatcccctaccattaaggatccttgtttgataatgcattcatgaatataaagggtatctaatacctttttcgtatctattacttcagcaatattatcattagcaaataattctttttcttgtctaacaattacattgaatattcccacatctcctttctgtcctccagattcagcataaaacggtgttatatccaataatatagaaactttatctccaacattagctatttcaacatttttatcacctccacaaactattgataaaactgtagccttagtatcataacgctcataccccacaaactttgtactaccacaacgctctttaatatctacccagaattcctcttttaactgctgatcagatttgatagaatgattaagtttagacctttccttttgtttattcatattatcataaaagccctgctcatcaaattttactcctttttcttttatgatatccaaagtaatatctactggaaatccataagtatcatacaacttaaaaacaatatcacccgataaaatatcacctgaagataaattcattaattctttttcaagcaatggcaatgctctgactaaagtatctttaaaattctcttcctctatctttaaaattgacattatcaaatccttagcatgaattaattcaggataatagtctgccatatatccacaactttcttcatcaattaaagtcgggaagactttatacattaaagcatcatcatattttaacatatacacataacgagctgctcttctaattatacgacgtaaaatataatttcttccttcattacctggtgttaagccctctgctattagaaatgctgctgatcgcacatgatctgcaattactctatgagcaagttcatttgtactattacctgattgctcttttgatgctgctatcaaagctttaaataaacttatatcataattatcatgtactccttgcattacagctgcaatcctttcaagccccataccagtatctatacattttttaggtaatacacataattcaccatctaactttctatcatattgcataaaaactaaattccagatctccgtaaaccttgcaccatcttcttctggagtacctggtaatccaccttttacattatctccataatcatagaaaatttctgaacaaggaccacatggccctgtatttcccatactccagaaattatcactagttgttattttaattattctactgtcagaaacgccactgatctttttccacaaatcaaatgcttcttgatcatcatgatatactgtaaagtatagcctatctttgctcaaagaaagttcttttattacaaaattccaagcaaattctatagcaccctctttaaagtaactaccaaaactaaaattaccaagcatctcaaaaaaagtatgatgtctatttgtatatcctacattctctaaatcattatgcttaccacctacccttaagcatttttgacttgatgtagctgtatttacattcgcattattcgggttagtaaacatctgtttaaattgtaccataccagcattagtaaataacaaagatgggtcatcttttagtattagtggagaagatggaaaaacttggtgaccattttttgcaaaaaaatctataaatgattttctaagattgctaactaaattatttttcatcatatattaatcatcataaaatataagctatataacaaaagtatacatttgatattacaaagcactataaaagtgataaaataaattgacttatacagcaaaggtataattattaatctatacatataaaaaatttgtgaactttatttataaataccatgatacttactataatactattgtccattacattactaataggaaattatcataaagtaaaacttactttcgaagataaatttaatatcataacttccctaaatatcatatacccattcattatctgttattcgttttatactcaacatctaaatataatatttatcctaataacatttattatattaattctaatattaatagcagcatacatagataaagaattcatactccttaaacttatcatgttttcctcagtaggtatactttctcttattgtaatatgtatagtattatgcttaacctacgaatcagcactatttttcagcaaaatatcattgattgactttctgtttggaactaactggcaacccagtccagacattttagatggaaaaccagttggatcattcggaatattaccactactcagcggtacactacttatagttattgttgcaataaccatagctgtacctttaggattactatctgcaatttatattagtgaatatgcaagcaaaaaaataagatacatagctaatacaacacttgaaatattagcaggtattcctacagtagtatatggatactttgctgtagtatttttatcaccatcaatcagaagtgtagcaaaatattataaccttaacgctcaatcagaaaatgcattagtagctggactagtcataggaatcatgatcttaccattcattacctctctcatagaaaatgctatacactccgttccaaagattctgcgttatgggtctatggcacttggagcatcaagagcagataccatatggaatattataattccatatgcattaccaaatattattagttcaattatattatcaatttcaagagtcattggagaaacaatgatagtgttaatggcagccggcataactgcacatttaagttttaatccattacatgctgtaactacaatcacagtacaaattgcaacaattttaactggagatcaaaacttcaacagtattcaaacttcatctgcatatgctttaggtctcacattgtttatcataacatggcttcttaatttactagcactacacattacaaaaaaagcaacaaaatctattaaaattcactaattccatatgttaaactatacactagactatctcagtaccaaacttaacattattcccttaatagggatagaattagaattttactttgataatatagacccaaataatatcagcccattaattagcaacattcaagacaaaatatcttctcttaactgtaatataacaaaagaacaagataatctacaatatgaaatacaaacatcaacaactactaacattcctaattttattattgagcttgatcttataaaagaaattttagaaaacaacacaaaacactttggagggagcattaatttctctgcaaaaccatatttagataaaccaggaagtgcatttcacatacatataaatttacttgattttcataataataatttgtttactagccaaaataacaaaatgagtgaccatctatcctacagcatagggggattatgctctttaatgaaaaaacatatgattttttttgctccaaataacaactcctacttaagatatatatatgctgacatagacaccccaacaactataagttggggaggaaataataggagtacttctatccgtataccaagtaccagtacagacccaacaaaatgcagaatagaacacagagtacctggagcagactgtaactataaacaagctataacatcagttctgcaaggaataatttatggaatagagaaaaaaatacagccaccacaaaaaatttatggtatatcctcagacatacaatataatcttgaaaaattaccattgagtttaaacgaatcaataaaatataacctaaagtagagaacttacaataaattgttattacaaatagactataaattaattttaccaaaaatagtttatgtaatagagaaaaaacaccacaaaaaatttacagaatatttttaacatataacacaacacataaaaaaaccaccattgaagtaaaatactctattgaatcacagttagcctctacaactttagctacacagcaccttaaacacagctaagtttctattcttatgatgttcacacagaactacgtacccctgttatgtgtctcacatttctctattttataataactacacattaagttgtaggccatcataaccaaccactatattatcttgagaacgacttcttatataatcaattaaagaatagtactctagatcatgactcatatgagttaaaatagcaacttctggtttgaactcttttatccaatctaagcataaatccacatgagaatgtgcaaaacttgcagtatacttcaagcaacctaatattaatacctttttcttatataaaaatttacaagattcttctgggaaagattggacatcagtgcaataagcaacctgatcattaaatataaatccattagaattactaacaccatgtaactgctttatagctaatatacaaaaatctccaatagtgaattctttataatgatatattgtatttactgttaaataatgacatttcttccaagcagaagtatatgcactaggaataaaaaaatacgaattactagcagtcaataaacataaagtatttatatcactatatataggtatgctattcaaaccgtgcttaggaagaaatggttgaagatcagcaataccatcacaatgatctgcatgaaaatgagtatataatactgcatcaacagacgataaattatttttcaatgcttgacatcttaaatcaggagtagtatcaacaagcagctgtgtatctccattttcaacaaatattgatgacctcattcgcttgttgtatgttaaatttgaactacaaacatcacactgacagcctactattggtactccaccagaagcaccacatccaagaattgttatcttcataaaaaatcaacatactcatacacgatcaatatcattagcaatttcattagtcaagtatataaataacattaagcatataaactagggctatagcaaactaaatgtaccattagaacacttataatatatttaacttactataaaaacataacaaactattgcataatcaaacataccagtacatctgcaaatgagatacttaagttactgtcacagattgaaacgtttcataccagtttattataaacattaagtatataaactagggctatagcaaactaaatgtaccattagaacacttataatatattcaacttactataacaaaaacataacaaactattgcataatcaaacataccagtacatctggaaatgagatacttaagttactgtcacaaattgaaacgtttcaataccagtttattatatgtatcaaatatcttatttttcaaacaagttcagattataattatttatcccatacataaaaaataacttattttaaatttttacagctattactattcgacaagtgctttacgtccttttaaattggatgcctatatacacattttcaactttattgcatactacgactttgagcatatatagtatgtagtttcataatatcctcgtctgaaaaaaatatactcttaatcttactaatattaaaatttcttctttttaactctgcagcacgttttatttcttgcacattttgttcagtaacttcttcattttctggtattaaactttcctggatcacagaataaaagttacacacatcaaacaacatgtcctcaattttactagtattaatattcaaattacttgtgatcacccttactaaatactcagacattacttttaatttttcttttggtacataacacaatgtaagtcctgaatcatctttctctactaatttacaactattatttcttaatccaaaaattgtatattgtaccttattattaaaaaaatccatctcacaagtataacttgtacaatgatgcaatgcatatactaaaccaagacaatcacgctgactagcctgacatcgaataccaaacattgtacacaaaaatatcattgacaataatattatactagctttcatcaacaaacctacctactatattatacaactcaaataaaatggtaccacgtataacaggtacagtttcaccttttaatacagcttgcaatacttcatttgtaatatccgtatttttttcaacattaagctgagtagcctgatattgaatactaaacattgtacataaaatcatcattgacaatagtattatactaactttcatcaacaaacctacctactatattatacaactcaaataaaatggtagcgcgtataacaggtacagtttcaccttttaatgcagcttgtaagacttcatttgtaatatctgtatttttttcaatattaaaattaacaacttttacatacccagaaatatcgtgacgtatcgtattaagaaataagaatacctgctcatcactaatagatgaaaacttaatctcaatattacgcttaattatatctatatgctggttatgatatatgttattaactattttcggactagatatgtttatctgagaattaaaaatataatacttcttaaacaaactgcttattagcgttcctaaatcttcctcataaaaagtactatatatatttgaagttgatatttcttgccataaaactccactatcatttagcatagcttcatgtttgtgaacgtccatgattttgaaacttaatttttgaatttcatcagcaatacgcaaattatgctgcactatataagtattaaatttatataaataatgtaatgtcatagataaaacaaccaacaatatcacacatacagatatcttggttatgcaatatcttcttaacaattttttgttcattacattacttctccagttttatcacaacaattctttgactatccaaaacattaggagcagtatctattacttccactttataatctccaaactcctctattattctatcttttaagctgttaaaataatatgaaaattgcttttcctctacaaatttcagtaacaactttactgctacaccatgactattcgtactaaatgacaagtaattgattttaaaacctttcaaatctatttttcgtaaacgtaaaatcaagtcaaaagaaaaaaaatcatctgctaaaagaagtttatatacatctattgtttcatacatttcactaacttgctttacttgagtatcttgattaattttctcaactcgagatactaattcctccttacgaagtagtaaattaatgctctcatcataattattatttatattaaatatataagtaacattcaacaaagacatcaatgcaataaaacataataaagaaggtataaaatacttattaaagaaggaaatcttacaaaataaactagtactcctcgtatgaaagatttttaacggttttttttctgtcatggcacataacactacagtatcacaaaattcactcatgacatttgaagattgctttaacatcaaaatttttgacaattcatacggtgtaaaaatattcgcatctatattcttaaaatcaaataacaacaaactagtttttatattactagaagttataacatacaaatcaattgtcgattctttactatatccaaatttcgtaagatataaaattgtatcagatatttcctgataaactttacctgcaataatacttggcaatacttcatctgcagctacaataatattactcacatgtatcattttgcctttatacaaaacgatttgtctaaaatcatttgttttagtataaactattaatatagtccattctccatcacccttaccttgaagttttagcaatttctcacaaagatatgacaactctattggtaataataatattccacaaaagttacacaaattatcagtaataatttccaacagtttcttagataaactgtttagttgacttgttacaaccatgtaatgccagtttttatctgaagtatctggttttgttaacaaaaatgcagaacctacatcacaatcactcataatgttactaagattcattttgactaaagacctagcaataattccactatatgtaggcattacatgttcagtataaatttgatcagaatgatttaatacaaggtatacttgagatttcttatacttaaccatacatgatataactttcgataaattcatatcctgttcgttttcaataaaatacttatcccgtatttcaccattaatgatattaagcactacagacccattatccccgacagatataatgattctatttttagacattttagaaaaaaatgacattatctttacacaaaatttatagtatttacgctagcttttataactaatataaagaagcatctcatttttactatcaactgtaataaataaagatatattaataaaaatgcgaaagaaatataactagatctttgaattaatactatttttacatgctacaacaaaaagaatgtaatctaatctactacaactggaatattttatataatcatacatactttttataatgcaagccatattcttgaagcatcttaataaaactttagttacagctttctatcactatattcctaatgattttttctcaaaaatcttatgaaaatatacaaagcaatagcacaaacactactactagaattaagtttatcacacacaattttataaaatacttactaaatatttacattgatcatattttttataatgcaagctatattcttgaagcatcttaataaaactttagttacagctttctatcactatattcctgatgattttttctcaaaaatcttatgaaaaatataaaaagcaacagcacaaacattactactataattaagtctactatacacagttttataaaatacttactgaatgtttacattggtcatatattgcttctttattttaacacaagcataatacagttatatgacttttactataacttcccaaacacctaaaatttctgttaatttaaatacttctaaccactttatttgacctataaacatcatattaataaataattttcatatgccatcctgttaaaagctcgaatttcatggaattgctacgttttttattaaacatttctagttctttttattttgactaataagaattatatttttcataagcgatttccatatgctgatctactcgagattcgaactcctgcaatctcttgtctattactcaattcaaacacttgcaattcacgaacatcatgagtcccagatctcctattattcatatacattgtaaaattccgcctcaatctattacaaccagatctattgtaaaatatccctacaaaaagtataacaaaaagcactacaataaatattgctccaactaataacccattattctgaaaactatgatctacagagtataccttactcctgctaatattattatttgtcaataaaaagctgtctaacctactcacattagcagttgtaatattcaacctatctgttacagcataatcactagttgtttcaagatcttcatcataaaacacatgttttcttatagtactttttcttttagcactagattgagtagtgctttttacattatactttgcccttttgcccaatatactatattcaacatctgaagcattacttatatgttttttccctgatgtaaattttgttctcttaactgttgtaaaatgcattggaatttttgtaacattcatgatatcacgacgagtatcagttggaatcgacgtgttacctacaaaatttgttacattctctatagaattttcagcacgattagtactcagaactgctgattgtgtagtactagatatcatagggaaatcatataatgtagaatttatttcagtgcttttctcaaacagattatgagtagtcatataagtagaagtagtagtttcatatacagatgtactattaacactagaaacacgattttgcacagcagcaaaaacatctttagattgtatttctcgaatattgaaaaacatatacatagcataattattatatgtcttcttagcttcgacccctctgatctcagcatgcatactttcaagcgatatatcttgaataacaacatttgtaaaatcaacaatatttgtaatttcatgacgcgagaattgcataacattaacatacgtaatgtttccacttctcagttgtaactctggtatctcatacctgactatattatctgcacctacagctgttaccactatattatttctaatataccttacatataatgatgtaacatgctctttaatctgcataaaatcatatatggaaagctgattacctgctttactatgaacaacaattaattgatcactatctttgaacttactgttaggtactatcccaacataagctatataggtattttcctcattacgaatagcagcaattacattaatcccacttactggaatatgatacttaacatcatctggcacattacatccataacgacggtttactacgcactcttctatatttaaattcagagtataatcaactgagatttcatatatactagaaaaaaacttgtgattgctgttaagatattttcctacataaagtaaatttaggaattttttagattccgacaccataattaatttgtcactatatttgccatatcctatataaccagaatatttaaacaaatacttggtattaaatttggcttctctagtaacaggtttaataagttgaaatttattatcacgatattgtatacgccacattacataaaatctatctggtaatttcgctctagcatcattatctactctcccaacaataacaatactatctacctgactttgatataagataacaggatatttaacttcttcttttagagaatcaatggaactacttaaacgtattttccccatatcaaacaatgttataggagaataatgtatcctatatatttttaatgatagcgtactttttagcttatactctctaagcactccttcagaaagtactacaattaaaaaatcattacctaaaccttttacaagtaacatttctggtaaataatgttctatagtacgatctagtacagcattatcattaaccttaacacggtaggtagagttaccatggctaatttcacatattagatcacttactacaactccacgttttacatagtatgcagaaaaaacagtatcatttttccgaatgaaattaatgctatacgcattcaaaatactaatctcattccgaatcacctcttgattataggatatttccgtagccgatactattggtttctgtaaatttctcataaatgaacacaaaaattaatgatatttaataatattataaatatttaataaatcaataattttagttaatttttttataaatataaacaatacgatatcaattaaaaaaatcaagattcattaatagatacaacctcgtaacctttcaaaatgttaaacttgcaaatatcttaactccctactatcattacttactcttatctaaaaaaacaaaagcatgactaaacatgaatttcttataattggaagcggtccaggaggatatatagcagctataagagctgcacaactaggatacgatgttgcaataattgaaaaagaaaatacattaggtggaatctgtttaaattggggatgtatcccaacaaaatcactactacaatctgcatcagtttaccataacatcaagaaagcaggtatttttgggattacagtacaagacataaaatttgattttaataagataatagagcgttcacgtgatgttgttacaaaactatcaaacggcattagtggattaatgaaaaaaaataacataaaagtttactatggtactgcaaaactactaggtaatagcacagtagaaattacagatcactcaaacaaaataattaatgttacatcaactcacatcattcttgcaacaggatctaaagccagaaatataccaggtatagattttgataataaaatagtttggaatgcgaaaaatgctatgacaccagataaattccctaaatctttattgatcataggtagcggagccatagggatagaatttgcgagcttttataatacttttggtactgaagttacaatagtagaattaaaggacaatatacttccacttgaagatcatgaaatatccgaatgtatgcataatattttaagtaataaaggaatcaaaattcatacaaaaagttcagtaacaaaattagaaaaattcaacaattacgctaaaattcagatctcagatacaatacatttacaagtagataaaattatattagcagcaggagtacaacccaactctaatgatattggtcttgaaaacacacaaattaaaacagatgctgcaggattcattattactgaccagtactgctgtacaaatgaactaggagtatatgctataggagatgttgctggagctccatgcttagctcataaagcaagccatgaagcagttctatgtgtagaaaatattgctgaaaaagaaaacaaaacaacaaataaaacacatcctataaataaaaataatatacctagttgcatattctcaataccacaaatagctagtgttgggttaactgaaaatcaagcaagaactcaaggttatgatataaaagttggaaaatttaatgcaaactgcaatggaaaagcagtagctatagatgaaacggaaggttttgttaaagttatcatagataaatctactggagagttattaggtgcacatatgataggagcagaagttacagaaatgattcatggatatgtcaccggaaaacaaatagaagctactgatcaggacataatgtcatctatcttccctcatccaacactatcagaaatgatacatgaggcagtactatcatcaaacaacggttcacttaacagctagtttatgttttctttaatactcgattaccgtattatttattacaagtacgtcaagctaagttgttttacttaataaaaatacatatttttccctgcaattttatataatcctataaagttagtcaagattattgacacactaaacaaaccccgcagtaaaaacacaaatacacctagccaggaatatataatataattgctacctcatttgaacagcaatgtatcccatatcaaaaacataagtacagtttggtatctcttttgtcataaacacaattaactctgaactattttcttgtaataattaagcagtgactatacatcataggtttcacaattaagcaatctacaaaaacacaagtcacaaatatagaatcaaagggatttctcttaaaataccactaattatacaatattcatttttgtattaaatagctacatatagttctacagttataagtatttcgcttatacattcattataaagttcttattttctatacccatattaactattcatcatatcaaagaactcattattatctttgcttagtaacaatcgtaggtttcacaattaagcaatctacaaaaacacaagtcacaaatatagaatcaaaaggatttctctcaaaataccattaattacacaatattcatttttgtattaaacagctacatatagttctatagttataagtactaccacttatacattcattataaagttcttattttctatacccatattaactattcatcatatcaaagaattcattattgtctttggttatcaacaatttatcccttaaaaattccattgcttcaacagatcccatcgatgacaatagccttcttaataaccatactttcttcaaacacacactatctatcaacatatcttctttccttgtaccagattttgaaatatctattgctggatatactcttttatcagatatttttctatctaatattatttcacaatttcctgtacctttaaattcttcaaatatcacttcatccatttttgaccctgtttcaatcagtgccgttgctattattgtcaatgatcctccattctctatatttcttgccgctccaaaaaatctttttggtctttgtaaagcattagaatctactccaccagttaatacttttcctgatgacggtattactgaattatatgctcttgctaatcttgtaattgaatcaagtaatatcactacattctttttatgttctaccattctttttgctttttctattacaatttctgcaagttgtacatgtctatatccaggttcatcaaatgtagaacttactacctctcctttcacagatctacacatatctgtcacttcttctggtctttcacctataagtaaaactatcaattctatatctggatgatttacagatattgaatgtgctatttgttgtaatattattgtttttcctgctcttggtggagcaactatcagcgctctttgtcctttacctaatggagcaactatatctattactctcatgcttatatcttttttactcacgctgataggatcattacattctaataatattctttcttctggatacaaaggtattaaatcatcaaagtgtacatatctttgtaactttgccatatctgtaaagtttatactatgtgcttttactaacgtaaaatacctttctttctcacttggcgctcttatttcaccacttactatatcacctgttcttaaattaaacttttttatttgtcctgcagaaatatatacatcatcaccacttgcagcataatttgcttcaggagaccttaagaatccaaaaccatcagataatatctctactacccctcctcctattgctgcacctccatcacttactacttttttcattaagtgaaatattatttcttgtttcagcattctaccattactaaccactccaaggtcttctgctattttcaacaaatcttctattgtcttcttttttagctcactcagatctaacacttttacttcttgttgttctggtactttctcttcttctttctcttctattatttcctcttgtacctctactacttctttctcttcttctttctctaatacaatatcttctgattctgacataaaaactctctctatctaaaattaagccaggttactaatgctcaagtactttttatataagctctgtggataaacacatcctcaacgttataaatacagtacttgaaaaattgatcagtaatggcaaactttctactccaagtatttacttagtaaaccttgtgtatatggcgacacatttgctaaattagcatacttttttattttgacaacatataaattatttaatcgcaacaacccttaatcttatatgcaccataactaattaaatggcatatcacacaatgtcctacaaataaagtcaaactgacaacaccatagacattaactaatcaacactacacaataacatcataacctacgtgagtacatagatctacaacatattatgaaaagcattaaaaaatatacgaaccaacaataagtagtccaataaatgttacgttattgtaatacagagtcaagacttaacttttattatacacaacatctaaaaactaacaacacattttcaacctaaaattatatatgtactttgagacagaaaatacattaattgaaattactatttgtcagaagattattattctgctagactgcatggcttgttaagaaatttaataaagtagtttatcaatgactgtttaatacatattatgatagatttccatctgtattatagagaaggcttgatatactatcagtgaatgtcatacttaatatgtttagtgttcaaatttagtactgaaagattgtattaacagtaacataaaaccatgatcaagtatttaacaatttacatttacttctcaagtggtatagataaagccatatatgtttaaaaaagttgccgtatatttaagttataagcaggagtttaaataatggaacacaaagacaacagtacaatgtatggaaccactattttatgcattcgtagaggcaataaagttataattgcaggagatgggcaagtatcgttaggacacactgtaataaaaaattcagcaaaaaaaataaaacgtttagccaatgatacagtaattacagggtttgcgggtgcaacagcagatgcctttaccctttttgaaagattagaaagtaaattagagaagcaccctggacaattactccgtgcatgcgtagaattagcaaaagattggagaatggataggtatttgcgtagactagaagcaatgatgattgtagcagataaatcagtatctttaataatatcaggcaacggagatgtattagaaccagaaaatggaatcgcagctattggatcaggaggtaactatgctttagcagcagcaaaagccctatgtgaatctaatgatcagttttctcaaaacatgactttggaatatataattaccactgcaatgaaaatagcttctgaaatatgtatttatacaaacaacaatattattatggaaaaaatagaggattaaaatgtttgttacaccaaataataaactcaaattgaataatgatacaacaaataatataaatgatgaacaagctagtagtgaagtactaaatagtgaaaacgctattagcacagaaggatatgaagatgacataaatctagatgacttatacaacccacaagaattaactcctcagcaaattacacaggaactagataggtttattataggacaagcagacgcaaaacgtgctgtagccattgccttaagaaatcgctggcgtcgtaacagggtacctgaaccattaagagaagagattatccctaaaaacatcctaatgataggacatacaggtattggtaaaacagaaatagctcgcaggttagcaaaacttgcaaaagcacctttcataaaagttgaagctacaaaatttactgaaataggatatgtagggagagatgtagactctattatacgtgacttagttgatgtagcaatcaatcttgaaaaagaaaaaagtcgtaaatttgtagagacaaaagcaaaatctttagcagaaaatataattcttgaagcactggtaggagctgatgcaagtcaagagacaaaaactatttttcaagaaaagctaagaaatggtgaatttgaaaattttgagatctccatatccataaaggaaagtaaaaatgcaatcccttctattgatattccaaatattccaggaaatcaagttggcattatgaatatcaatgagattgtacataaaatgctaggaaataacaaacaacttaagactataaaagttactgtaaaagaggcaagagaactgctaattaatgaagaaagcgaaaaattaatggatgaagataaaatcatcaaagacgctcttttgttagcaagtaacgacggcatcgtatttctagatgaaatagacaaaattgcagctcgtacagaaatcagaggagaagtgaacagagaaggtgtacaaagagatcttttaccattacttgaaggaacaagtgtaacaacaaagtatggtactattacaaccgatcacattttattcatagcatctggagcatttcacttggctaaaccttctgacttattacctgagttacaaggacgtcttcctatacgagtagaactgaaaccgcttagtaaagatgatttagtacgaattttaaccgaaccagaatcaagcttattaaagcaatactgcgcattaatgaaaacagaaaatattactattgactttactgatgagggagtatctactatagctgaaatagcatctacagttaacagagaggtagaaaatattggagctcgtagattacataccattttagaaaagctaatggaagatatcagttatactgcaacagaaaatagtggtaggacatatgtgatagatagcgaatatgtaaagaaaaagctagaagacattgcaaaacaattagatttatcaaaatttatattatagttatgcatgaaagatcaaagtttgttaatcaagtttttacttcagtagcctcacgctacgatttaatgaatgacataatgagctttggtcttcacaggctatggaaagataaagtgattcagaatattactaagggtagcttacttgatgttgcatgcggtactggagacatagctataaaagtagcaaaaaatacacaagatgtagacataacagtatgtgatattaatccaaaaatgctaaattatggacgagataatgctgttaatgcgaatgtattaaatcttaaatgggtatgtagtaatgcagagcagcttccatttctagatgacagttttgactattatacaatttctttcggtatacgtaatgttttacatagacagcttgcattaaatgaagcatatagagtcttaaaacaaggaggaaaattcatatgcttagaattctctccattaaaagaaagtcaccctctttacaaactgtataacttttattcatttaatattatccctcacgtaggacaagtagtagcaaaggatagagcttcataccaatacttagtagacagtataagtgaattcccttaccaagaagattttgctcaagaaatcaaaaattctaattttgttcaaataaaatataataatttatgttttggcatagttacgttatatactgcttggaaaatataactaaccttatatataaaagttcttcccttacagaataataccatcaagaataatttatataagaacttcccacactatatcacttatcaacataaatctatatacattttatttttttcaaacatagctttaattaacatttttaattgatttcacatctcgaataaaaaagtttaatgctaaggaagtttattacccaagtctttcacaatccatataatttatttaaagctacaatatcgtataaagaagtgtatgctaaatttagcataaaatttatcaacaaaaaacctacaattgacacatcaagatccatttaagtttagcaaacaaaaaacttctttacacaaataacactcttcacattaagatactgctatagtatttatcatctacactttagtttttataagttcagcatatatgtttcataagatttttgcaaaaataggctctggttttggtaaaactgtattcatatttataggtatagaaaatcgactaaagtcacgattacattctggtaaaccaatttgatctaatattttagatgataatttaggcatgacaggttgcaacagcaaccctatacatttaatatattcaagtaatttatacaatactgcttccataattttagggtcactcttagataacctccatggcgctcgtgatgcaatatattcattagctgcagaagataattgctctataatatgtatcatctcattcagattacaacgcattacacaatctctaaccttttcaagaatctcttgataatctggtaatacttcctcaccctgcagcaaattgccacttactgttggtactatccctccacattctttatacaatagtgaaacagttctttgtacaaggttccctatattatttgctaaatcataatttatacaattaataagactatttcttttaaaatctccatcgttccctattggcatttctttaattaaaaaatatcttaattgatcaactccaaattcttctactaggtcaaaaggtttaataacattacctaacgacttagaaattttttgcccctcattagtccaccaaccatgtgccaagatttttttaggtaaaggcaattcagctgccattaaaatagcaggccaatatacagcatgaaacctcaatatatccttacccacaacctgtaaaacagaactactatcacttgcccaataagcttgataatctttatggttctcatcaggaaaccctaatactgtcaagtaatttgctaaagcatctacccaaacataaattacatgtttatcatcatttggtacttttattccccataaaacattttgtcttgatacagaaagatctttcaaccctgatttaacaaatgatataacttcattataccgatatttaggaataacaaaatcaggattttcctcgtaaaaagctaacaacctttcctgaaaatttgacaatcgaaaaaaataactcggctcttctatccattctacatcagctcctgtaggagctttaccatcgaccaattctttctcctgataaaacgtttcatctcttaccgaataccaaccagaataactacctaaatatattgccccattatcacacaaacgctgccataaagctaccacagtctttttgtgccttgtttctgtcgtacgaataaaatcatcatagctatagttcataacatcagctaactgtctaaaaacagcacttgtattatcagtaaaatctaataatgacatgttacgttcttgggctgctttttctattttttgcccatgttcatctgttccagttataaactttacactatgtccatcaagacgcataaaccgtgcgataatatcagatatcaaagttgtataaacatgacctatatgtggcacatcattaacataataaataggagtagtaatatatatattattcataagttagcattgttattactttatacagttagcaaattatcacataattttagttatattaacttaatatttgcagatattacaaaatattgacttataaaaactatatacaaacataagccctaaaacagaccacttttaattaatcccatataacagtaactactagtacaaaatgtacgatactaaacacgattatatacaagatgacatcaatacacattactatgagtcatactatcacaattcattacacaataaacaaccacattaatttctacataagcagttttaacatcctttactgacccacaatttcataaaaaaaacttagaacagcaatttgcggctttgcttatcctcattgctatagaaacaatactcccaactgaatgctcttatttttataaaaatttaaactagaccaaccatatttttccaagtagtacgtaagataactatacaaaaacacaaattatgattaccctagctgaacaaaattgataccttccacacaaaatcctacttttctaataactattgtttcacaatattaattatataataaagaatttaactgtattaatacaaactttgcaaaatataaaaaatcacttatcatttaattaacagtcatatatttctagcacacaacaatgaagaggattttagtaaaaaaatttggaggaacttctttacaagacatagaatgcattaatagagttgcagaaataataaaacaagatgttaacaataattataaagtagttgtagtagtatcagctatgggaaaattcactgataacatcatttcacaaattaaacaaatttccgatgtcaaatctcaatctgaacgctccgaatatgatctaatcatttcttcaggagaacaaatatcatgcggactattatcattagctctacaaaaaataggaatcaatgctcaatcatggttaggatggcaactaccaatagtaacaactgaagaccatactaaagcaagaatcatagatattaacacatgttcactacaggattcactagctaataatgatgttgctattgtggctggatttcagggaatgcataaaaacaatagagtaacaaccttaggcagaggaggttctgacacttcagctgtagcaattgcagcagcactaaaagtagatttatgctacatttacacagatgtagacggaatatatacagcagatcctaatgtggtaccaaaagcacgcaaattagattacattacatatgatgaaatgatagagatgtcttctcttggcgctaaagtattacaagtacgttcagtagaaatagcaatgaaatataacataaaattgtgtatattatctacttttaatcctggaaaagggacaatcttacgcaaaaaaggagaatcagatatggaaagtcaattaattactggggttacatgtaataacaaaacagcaagtattacactaaaagaggtaaaagcaatatctggcgttaccacagtatttaatgcaatagcagaaaaaaacattaacgtcgatatgatcattcaaagtgtgaatgataacaatgcaaatgatatcacttttacaatttcagaagaagatttgccaacaacaacaaagtttttaacagaaattcaaactgaacttatgtatcaggatttaataatcaattccgaagttgcaaaagtttccattattggagtaggcatgatttctcattctggagtagcttacaaaatgtttgatactttaacatctaataatataaaaatattagcagttactacttcagagataaaaatcagcgttctaatatcgagaaaagacagccaacttgcaacaatagcattgcactctacttttggacttgataacacagaatcagatttacacataataagttaatctatttataatatagcttataacccttctggtgtttagataacgtattacatataagtaatatagttttaagaattattaaacaacaataaacgtagcacttatttttaagcttctatgaattctgtttggattttctataaaaatcctttctatgaattaaagttcctacattacaacaaacactactttagaactagactatgacagctatattttttaagatttcaatttcttttatcttaaacttaattcagcatagatcatcataaacaacataatacttataagtcatcattaaaaaatgatttcatatctctataaattttatattagaaagcaattattacctttaaaccagattttggaaccatatcaattaagtcttatattacttagattttagtcaattactttaatttttcagtcttcaatttaacaataaattaatttgtaacataataaataaaggactctttagattaaaaattacattacacaagtttttttaatctataaaatgcaacatatacactgaaaatttgtaaaatccaatctcttctggaaaaaatttgcaaaatacttttcaaatataacgcagataggtttacaagtactgtagcttttagctataatcaaacgatagcttttagctataattaattttataagtctatacttcttaaaaagtagtataaaattattgcattttggtcctcaaaatgataaagatgaacggttaatagtgtaacattatgttaagatttctgtttttttttctctttatgtttagttctcttgatctatttgcagcacctgtgcagtggcaaatggggtttcaagctcctgcaacagaaataatggagtccatcataaggtcccataactttgttatgtttgttatgtcaggagtagtagttgttgttttctccatcatgatctacgttcttataaggtttagaaaaaaaccagaagataaaattatcttcaatactaagaattctcataatgtagttttagaaatactgtggacgttaattcctttaataattgtaggatttttaaccataagtaatgttaaactaattagacaagaacagaagattcctaaggtagaaatgacattaaaagcaattggttaccaatggtattggggatatgtgtatccagattataaaaatttcactttcgatagttacatgaaaacaacagataatttggaagctcaagatttacgcctacttgaagtagacaacagggtagtagtacctattaacacaaacattctgctacaagtaacaagcgcagacgtaatacatagttggacagtaccagctttgggagtaaaaatcgatgcagtaccaggcagattaaatgaagcatggtttaatataaaaactccaggagtatactatggacagtgttcagaactttgtggaagactgcatggatttatgccaatagtaatagttgctgttgaaaaagaacaatttgacgaatggatacaaaaaaagacacttgaattatagaggcatgcatgagtagtgaacatacaccacaggggataagacgttggttgttttcaacaaatcacaaagatataggtacattatatatcattttttccattattggtggacttgtaggtggtataatgtctcttgtactgagattacaactagcacatattaacgtattacatgataactatcaattatataatgttattgtaacagggcatgcattaattatggtgttttttatgatcatgccagctttaactggaggatttggtaattggttcgtaccattgcttataggagccccagacatggcattcccacgtcttaataatgtaagcttctggctgttggttgcctcactaattctattatgtatatctgtcttgataggagaaggtgcaggtacagggtggacattatacccaccattatcatatatcgggtctcatccaagtgcttccgtagatatagcaatattcgctatacatgttgctggagcttcatcaattgtaggagcaataaatttcattgtgacaatattcaacatgcgagctcatggcatgacattgttaaaaatgccactattcgtctggacaatattattaacatcttttatgttaatagtgacaatcccagttttagggggcgcagtaacaatgctattaacagacagaaattttggcacaagtttttttgaccctgctggtggaggtgatcctttattattccaacatctattttggttctttggacacccagaagtgtatataatcatattcccagcatttggaataataagccaaattgtatccactttttctcataaagcagtttttggatacttaggtatggtattagcattagttggcattgcagctgtaggtgcagtagtatgggcacatcacatgtttactgttggattaagcgcagagattatgacatatttcagtgttactaccatgttaataggtgtgttaacaggagttaaagtattcagctggattgcaactatgtggggaggacaaatagaatttaaaactcctatgctattttcaattggatttatcttcgtatttgtagtaggaggagttactggtattgtaatttcacacggtggtatagataaagcactgcacgacacatactatgtagttgcacatttccattatgtaatgtcaatcgctgcattgtttgctgcctttgctgctttctattactggataggtaaaatatcaggtaagcaatataacgaatgtttaggtaaaatacatttctggttaacttttattggaactaatattacatttttacctcaacactttttaggtgtagcaggcatgccaagacggatcccagattacccagatgcttttattccatggaattatatatcatcagtaggagcattgatatcattcatatcagccttattttttgtttacataattatttcaacattaagaaatggaaaaaaatgtcctagcaatccatggggaggagatacattagaatggacaataccatcaccagcacctttccatacctttgaagaaataccaaaggttgattaagcatgagttctaaatgtgaaagtgttaaaccacagcttgtaaatgaagtattaggctattgggatctactcaaaccaaaaatcatgtatttagtagttcttacaggaattacaggaatgattattgctccaggaaatattcatccttttatcggtatcatcagtaccttatgcatagcactaggatctggtgctgcaggagcaattaatatgtggtatgacagtgatatagacgcattaatgcaacgtaccaaaaatcgtcctataccttctggaaaaattgctagatctactgcaattgaattgggattagtgttatccgttatttctgtaacagtaatgatgatcgccgttaactatctatcaggaatattactagctatcagtataggattctactcacttgtatacacaatgtatcttaaaagaagaacaccacaaaatatagtcataggaggaattgcaggagcactgcctccaattattggatggacttctgtaactaacgccatctccatagaaagcttgatattatttctaattatatttgtatggactcctccacacttttgggcattatctttattaaactatcaggaatacgaaaaggctaaagtaccaatgttacctgtcacacatggaatattcactaccaaaatttatatactagtatatagtatcatactatttattataacactattacctggaatatttttaaaagattgtttgttatatgaaacttgtgcaataccacttggcatgacattcgtgttccatgctttcaaggtatttgtatcaatcaaccactataaatacaaagcaatgtttacttattctattgcttacctctttattttattcatatgtattattatctcaagtttttaacatcccttttaattaagagattccaaaacatcaataaagcctcactacaattataaactattctttgttatttaaccaaaggttctttataccatccagtatcaatacaacattctttaagtaatgacatatatcttgcataggcagcaatatcccccaaagctaagtacgcttcagcaattctatataagctttctgaataatatttcgtatccttatacttatttaatattgtactaaacctttttatagcagcaacatattcaccacgttgcaaataaaacttacctattgaaaattccttaccagcaatatgttgatgaacaagttctaatcttttcataacttcttctaaatacatagagttgggaaagagacgtataaactcattcaacaattccaaaactttatgcacactactttgatcacgatctatatcactaatttgcatgtagttcgccattatccttaaataatatgcaaaatctatatccttactatcaggataaagttgtatataatcatccgcataaatttcagcacgagaataatcgccaagttcataattcaaaaatgacatcataagacgagcttttatcgccacaggagaaaatgggtaaagattgtctatttcctcaagatcttttaccgcactcttatattctttggcattagatttctttaaggcactctcatacatttcatctgctgttcgatcttcaacaaatttttctcccttctttatgaaagagcagtttaccattaaaaaacaacaacataacaagtaaacagccttgcgaataattttagagtgacacatattcaatcacctataaatataacttgtaaatatataaatatcctattgaaacataaagatgtatcccagacaagcaatttttactaatgtacttacactagcaagaccatataatgtattgacaactatcatattgatactagaatgcaataagtacaaactaataaagcatactaatgaatgtattggtgattggttctggcggccgtgagcactcaatgttgcatcacattcgtaaatctacattactaaacaagctatttatcgccccagggcgtgaaggaatgtctgggttagcagatataatagatatagatatcaatagcacaatagaagtaattcaagtatgtaagaaagaaaaaattgaattagtagtcatcggaccagaaactccattaatgaatggattatcagacgcattaacagaagaaggcatattagtctttggaccttctaaagcagcagcgcgtcttgaatcttcaaaaggatttacaaaagaattatgcatgaggtatggaattcctactgcaaaatacgggtactttgttgatacaaattcagcttacaaattcattgataaacacaaattacctttagtagttaaggctgatgggttagcccagggaaaaggaacagtgatatgtcacacacacgaagaagcatacaatgctgtagatgccatgttagtgcaccacaaatttggagaagctggttgtgcaataattattgaagaattccttgaaggcaaggaaattagcttctttacattggttgacggatccaacccagttatacttggcgtagcacaagattataaaactataggagataataataaaggtcctaatactggagggatgggatcatactctaaaccaaatatcattacacaagaaatggagcatataataattcagaagataatatatccaactattaaagcaatgttcaacatgaatatacagtttagaggtctgttattcgctggtattataatcaaaaaaaatgaaccaaaattacttgaatataatgtacggtttggagatcctgaaacacaatcaatattaccaagattaaattccgatttcttaaaacttttatcactaacagctaaaggtaaactaggaaatgaatcagtagaattaagtaaaaaagctgctttatgtgttgtggtagctagtcgtggatatccaggtgagtataagaaaaattctataattaatggaatagaaaatattgaaaagctacctaatgttcagctcttacatgcaggcacaagaagagaaggaaataactgggtatcagattctggaagagtaataaatgttgtagcacaaggtgaaaatttagctagtgcgaaacaccaagcctacgctgcattggacttattagattggccagatggaatttacagatatgatataggatcatgtgctctttaagctatactctatgaatatttagcataaaattagataaagcacgatttaattgtgcaagccgatttttgaatattacaaatcttgatccagaaagttttgtggcttgtgtgaaatccattaaatttaaattttccctaattcataatgagtttttactggaaaatcaaaacttgttttattctcgtatcttctcaattcaacattactgttttcgtctttcctaataggtactcttttatctggtatatttggcaacatattgagaagattaactaattgagaatcttcttttatcatgttgttaatatcgtctattttacttgctacatctttcgataattatatttgtatattttaacattatactgatattgcttatttgaaattactaatattaccaggtgttctttttaaaatataatagcacaaactacatgtcacacttttgtaaccctcatttgttacatcgcatataatcacatccaatctccatattacaagcaattaccaatcgataacttttaacataggaagtaaagtttgatctatcactaaaatatgtatacttctattatacccataacttaaactcatggttactttgtatattcgtaatcaccaacagcagattatttttcaaaataaatagacaatttctatacaggacattccactttctaataacgcttatgatattctagctaatttcctatatattagattttaagccaaattgatattgacaaccaacactattcttgatacattgattttattaacctactctttggtattaaaaatgtcacttatctctgaagtctttgcagcagcagcaacaacagcacctgcttcgggaataggtagttcaattgcaggtttaattcccttagtattaattttttgtgtcttctatttttttataattagacctcaacaaaaaaagattaaagagcataataaactgctagataatataaaaaaaggtgataaagttgtcatttctggcagtatactgggatcagttacgaaagtcgatacaacaaatgggcactttattgttgaaatatcagaaggagttgaagttaaagtattaaagtcttcagtatctgaagtgttgaataaaaataacaagcctacttcaactgcagaagcatcagttgcagcttctaataattaatacataactaaatcttcattcgagaaaaagagtgtttatatttccttattaattttaaggacaccttttttaacaaacagccaattttagataatataaaactactaacagaatttaatataacaaattctatattctcataggcataataatgtaagtgaaatcatctatattttcttcttcctgtattaaaacagatgtaccagcatcataaaacgataaaagacattttccttttatacaatacaaagcttccattaaatatctggcatttaaaccaatagtcatgtcttctccagaataatctacttctaattcctctctagcatcaccttgatctgaagaagcagcacttaatataagtttattactcacaaaccttaattttatcacttttactttatcaaagactactacagatactctatctatcgcattagataacgtttcagattcaattaatacattcttatcatgagatctaggaataatagaattataatccggaaaagtaccatctattactttagatattaaaatatattctttatactcaaaacaaatcttcctatctgataaactaattgatattaaatcattaccactaccatgacttactatcttcaaaatttcattaactgtttttttgggaactataataccaaaatttgacaatacattctgagattgactcaacttagttaacgacaacctatgtccatctgtagcagcacaacataagatattattggacgtatgaacatataatccattcaaattaaatctactctcttctatggaaattgcaaatttagttttaccaaacaaactaaccaattcagagacttgcaaagtaaatttgttttgtaattcattattttcaataataggaaacttctctatatcaactacaggaagaaaaaactccgtacgaccacattttatagttaatcttccatcttcaccaataaaaaatttgatttcaatatcattaggcaacttttttacaatatcataaagaagttgagcagacactactacaactccattaacgtttacatgggcagtaatagatgcaattattgaaatatcaagatctgtagatgttaacttaatttcttgatcccttgcttctattcttacacacgacaatacaacaatactatgacgtttttctacaatactattaatgtaagacaaagcttgcagtaatttatctttgctaacaaaaaagttcaacttaataccatcactcatatatttctatataaacctaccccattgtgatgttatacaaattaaacttaaacaagtcaaggtatggatcactttgctctatactatgatataatcacacatccaatatcactctagcacaaattaagttctcccaaaatacacttaaaatactctatttaactatatgctacaaattttcaatacaaaatagaatcaagtaaacaatactcagtattataaatttttcaaactcttcttctatactattgatgcactataacaatattatcctgataaatagacttttaactacttgttatagcaatttaaaagaccatcatcgcctatttatttcacaatgtgtttaatataacaactctcaactcttttaatcgctaagttaacatctacagatcttgatatttcaataattgcatctattactgcccatgtaaacgttaatggagttgtagtagtgtctgctcaacttctttatgatattgtaaaaaagttgcctaatgatattgaaatcaaattttttattggtgaagatggaagattaactataaaatgtggtcgtacggagttttttcttcctgtagttgatatagagaagtttcctattattgaaaataatgaattacaaaacaaatttactttgcaagtctctgaattggttagtttgtttggtaaaactaaatttgcaatttccatagaagagagtagatttaatttgaatggattatatgttcatacgtccaataatatcttatgttgtgctgctacagatggacataggttgtcgttaactaagttgagtcaatctcagaatgtattgtcaaattttggtattatagttcccaaaaaaacagttaatgaaattctgaagatagtaagtcatggtagtggtaatgatttaatatcaattagtttatcagataggaagatttgttttgaatataaagaatatattttaatatctaaggtaatagatagtacttttgcgtcagattacatattataaatatgactaaacgacattaacactactacgataattgaccaatctgttaaacaaaaactaaacctactaccctctatatactacaatacactcaatgttataaacccatgaaactactggcactataatatacagtaaaatacataacattacctaaatagattaaagcaagttcttgttaccgcacacaaattgaacatcataaacttctattcatttctataacataataactttaagataataaataatgcataacacatagctatacaattctatcgtaaaaaattacttagtactatgatgcatgactaaatatatcaacaccatcccaacctaatagatcaagctgagcccttgttggaagaaatccaaaacaagaagctgctaactcctgtttattctcacgctgcaacatagcatccaatttgttctttaatgcatgtaaatatataacatctgatgctgcataatttaattgttcagacgttaaagtttcctttccccaatcagatgactgctgcattttattaagtttgacatttaataattcataacatagctcttttaacccgtgatgatctgtatacgttcttactaactttgaagctattttagtacaataacacggtgtagcccatacaccaagataataacgtattacagcaatatcaaagcgagcaaaatgaaagatttttgttatacttgaatctgaaagaacacttactaaattaggtgcttgataactacctaaaaactttactaaatgtgtctcaccattactatcacataactgaactacacacaacttatcccgcctacacactaaacccatagtttcagtatcaacagcaacagtattttcaaattttaacccattaggcaaatcacaatcatgtacaaatacaggcacgtaaatttcctccacctacaaagtatatataatacctttgttcattgtatcatgtagtaaaatgcctctcaactatattatgcttcctcaacatactttttatcttcctcttgaccataaattgagtcaacattggcaccaccatgatcccatctatatcctcctctatcatcactttcatcttcgtcaacacactcttttaatacataaccacgtccccaaacagtttctatgtagtttttcccattattagcgactttaagtttcttacgaagcttacacataaacacatctataattttatcatcagaaggttcatctaactccctatataggtgagataaaaacatttcttttgtaagaacagtacctaacctagatgataacaactctatcatcccatactcctttttagttaaatgcactatttcaccattacattcaacacacttatgatcaagattgattgcaatatttccaacacgtactattgattcaggatgtcccctagtacggcgcacaatagcttttattctcgcaagtaattcacttttatgaaaaggtttagtcacataatcatctgcaccataatataaaccttttactttatgtgatactgatgaaatacatgataatataagaactggaactttgataccagactctcgcagtttcactaaaatatcatatccatctatttttccaggaaaatgtatatctaatatcactacatcatagtcatcattcttcggaatgatactaccataacaatcctgcgcagaagtcatagtctcacaaaaatgcccttctgaagataaagaagcttctactgcctttgcacatgcaatatcatcttctattaataatatacgcataaaatacctctaaaaacccaataattaacaaacttaacacataaagcacttagcactaatctaaagacataatcaccctataacaactaaacatttcatcaaaagttaatacatagtgttactatgctattcaagtataatagtaaattacatgtaatatactttccttgtgttgcatatataacacaatattaccccaaagactattagagacattatagtaaacacacctatttttccttaattagtaaaatacttcactgattatatataagcacaagttaatactttattaataataaaaatggttaacacacgtactactatacattaataaaagcattcacactaatataaaaatttcaaaatttgatatctattttactcataaagatcttgcataccaaattattctccctaatatttccatatcttctaaatgacactcataagaagaatattttttattatcagaaactacatgtaactttatcttctgattatcttttaaatactctaatctcctaattgatacacctactgaatcaactataacaaataatccagcaggatgaggaattttatctcctatatccactagaactacatcttgattcattaatgttgggatcatactatctccctttacgtaatatacacgtaaattcttcatattagaagttaaattaatgtttgaagagagatacaaattaacatcacctgaggatgcaactttaccattttccaattctaaatcatatacaggcattatattaacattattctgtccataagtataattatcatcactaataaaatatgataatgaaacgtttaataccttcgctattgccattaattttttagatgtaggattcgttgatttaccacttaatatatcatatacaaaagacttaccaacatcagctttatgcgctaattcacgcgcatttattcccatcttatccatttggtatctcattctagtaactatcatactattatcactacttgttttcataaattcaccttacagttaatatttattacatttttgtacaatttaaagtacataaactcaagtaataattgaattattcattaatagagaataccaaatcataaaattactagtgagtaattataaaatttacacaaaatcagtgctaacttataaaaataacttttccataaagttatacatagcagagcttgcattctattaaaatctacatgcaatttgataattaactaaaaatactaaccaagtagcaatagcaacctaataatcttcaccattgctaaaaaatagaacccccaagcattatttataggtgatccatattttttataaagtcttctattttagcaatccatctttgcaggataacaccccaatataaaaaccattactacaccaattaaataaaacgcttaactacaaaaccttatagtcatttaataaatcaactacaacaataaaaatcgcttacagtagtacttcccagattatcaatttcttataaatataagcactgtagcactattacaacctaacactacaacatttatttaattaaagcacttaatatcaatttttctgcaaccgtaacatctttccaaccttccacagatacaaatttatcttcctccaattttttataaaaagtaaaaaaatgggatattgaatttaaaaaagatacaggaaaatcggaataatcttttatattattatagtattggtctactttatgtgtaggaacagctaatatttttacatcttctccactttcatcatgcataactaaaacacctactggccttgcgcggattaccgccccagacattacaggaaatctagatgcaaccaaaacatcaacaggatcaccatctccagcacaagtatgtggaataaaaccataattacatggataatacatagatgtaggtaaaaacctatctacacaaaataaatttttctctttatcaaactcatactttaccggacaggaattctgactaatttcaataataacattgatttctttaggaacattatcaccaccagtcacattgtctaaattcataattaatctcttgatatcacaaacaaataaaaaaaattttgaatagatcaataaatgaccatcagcttatatactaatatcctttatattctagtcaatgcttttcttaaacaggaaatactcataatataaagatttttaacaatataataaagctctatatacaattacattgacataataatatttttatcacctacactgtattattgcaaaatataacattaatcaagtaatacaaaaaatgctatattgcttaaccaacccacataattacttacaaaaacataccacatactgatacattaaaagaagacaatactgataaaacagttttcttaagaatatatcacaataattaaatcttatgccacttaattaccatagtaaattatctataaaaacacataacaaacttacatatctatgtagacaatgaagtacctattgcaaaatataacattcacaaagtaatctgttacttgtacacaaaaatcccatactgcctaaccaaccccataattacttacaaaaacataccacatactgatacattaaaagaagacagtactgataaaacagttttcttaagaatatatcacaataattaaatcttatgccacttaattaccatagtaaattatctataaaaacacataacaaacttacatatctatgtagacaatgaagtacctattgcaaaatataacattcacaaagtaatctgttacttgtacacaaaaatcccatactgcctaaccaaccccataattacttacaaaaacataccacatactgatacattaaaagaaaacagtactgataaagcagttttcctaagaatatatcacaataatcaaatcttatgctactcaattaccacagcaaattatctataaaaatacatcacaaacttacatatctatgcagataatgaagtacctaaagtaatcaacctgatgaccaatacatcaaaataaatcaaactctatacttctatcaatcacacagactatctgtctaaaaaacagatcttaaatttatatactttaaagtaaatatttaaaaataaggaatatttgacaaagcaattttctcatcataagacatcataacattaaaattttgcactgcttgaccagctgcaccttttaataaattatctataacagacatgataataatcgtgttaggtacccttccaggaaaaacacctaaataacaataattcgtacccacaacagacctagttgtcatagctttctcttcatcaataaaaacaaaagatgaatctttgtaaaaaagcaacaatgcttcacggacatcagtaagcgatacgccttcttctaactcaaggtatatactagacatcatacctcttttgacaggaattaaattaggcacaaattgtaaattaatgtcttctctacaggcagcaaaacaaagctcttgctctatttcaggaatatgtctatggtctgaaattttatacgatttaataacatcataaacttcacagaacaacttatcctgctttacagacctaccagcaccactcacacctgatttagcatcaactattataccctgactttttattaaacaaagtcttaacaatggaaataatggtattagcacagaggtaggataacatcctggacaagctataaaccttgacctttgaatatcttcccaatatatctccgttaacccgtatacaaaatctcttacaagatctggacaacaatgtgagccataccattgtttatatacttcagcatccttaattctaaaatcagctgataaatctataattcttactacatcatgaatttttcttacaacttcacttgatgtaccatgaggtaagcacaaaaaaaccacatctactttagataagtcaatatcatcaaaagacgaaatattaacggatatatcatcctgcgaaatgtggaaataattagaagaaagtaactttccactagattgagttgcacataaatactttatcttaaccataggatgagataataacaaacgtactaactctacccctacataacctgtagccccaactacagcaactgatacttgataactcatttaataggttatcttttagagaattgacaactttttctagccttatgttgaccatactttttacgttcaacaacacgcgaatctctagtcaagaacccaccacttcttaaaataggatgaagactaggattaatatctttcagtgccttactaattccgtgagcaacagcacctgcctgacctgaaatcccaccaccactcacagtagcaacaacgttataacacccagaagttgatgtaacaataaatggattataaacctttctacacaaggtatttttcttaaaatagttaaaaatatctaaaccattaacagtaacattccccttacctactgttaaccatacccgtgcaacagcttcctttcttctacctgttccataagcacggccacgagcatctacttttacagctttgatgtgatcatcttgttgatgatcagataacatatcaggacttttctccattatctcctcttattattcttagcatttattgataaaaaatctaactttacaggttgttgtgcattatgcttatgttctggacctgaatatacatataaattctttaaacgacgacgcgccatcgggccagtactcaacatacgacgtactgccatattaattatacgttctggatgtttatttaaaaacaaatcagctggcgtacagctttttagtccaccaggatacccagtgtgcctataatacactttatttttcaatttactaccagtaaagtgaaccttttctgcattaattataataacattatctccgcaatccatatgaggcgtatactcaggcttatccttaccacgtaatatattagcaacaaaagcagcaagcctaccaactactactccatctgcatctattacaacccaacgcttctttatctgacttgcttttaaagaaaaagtctccatttgcatctatcgttaataaattttcatagtaatcatacaatcaatttttgtcaataaaaactaattttatttactcttcatgtgagtcctatataacataactttgatattccaacagtaataaaataaaatgcaaaagtatgctatattcaaattgctgattatagataattaacaagtaacaaagatctcttttattttacagtccttaggaaaaatttgtactactcatataccttacgcattacaacttatataagacgtaataacattttaaatacatatccttataaacccaacacataaaagaccttaaaacttatatttataatacaactcatttgaaatcaactacccatttatattccatttctacagtttattgcaataaaactccgaaacttataacctatgcttaagtaataacatagaattgaattaatcaaacttcacacttaattcttgctaatcaaaattaattacagtttaatcattgctagtattactagttggtaacatttaatgataagcaaatttaatatacgtaaggtttgttatacattgatattgatatctatgtcaattatacctaataacagttattgtactaacttagatgaagctttacaggctgcattatcaaataaccccaacataaaagcaaaattctatcattccttagggaataaacaaaaaattaaattgaatagcatatcaaagtttttaccatcaattgcatactccgtgcaggtacatcagccagaattatctctaaccaacaatagtaatagaactatgagcctcatagttactcaacagctattcaatggaggagctgatgccgctgcttttcaacaatcaaaatacttaacaaatatagaagatattgatttttcactagagaaacaaaatgttatacttaatacagtaaaagcttacatgaaggttttaacaacagctgaggtatataagttaacacagcatactaaaaaagtattagcagaacatttaacagccacacaaaaacgtttttctttaggagaagttactaaaacagatgtctcactagctactgctaggttatcatcagctacatcagaattaatcaaagctcacggagaaatgaaagttgcagaagctaactacattcacataacaggagaaataccaacagatttacaaaatcctgctataccagcaataccatcatctgtagaagaagctttagaaatagctcaaaaaaataacctttctctacaagcatctcacaacggatataaagcagctaagcagggtatcttaatggcaattgcacatttacttccttctattagcatatcatcaataaattcttatacttactctaatattcctaacacaaatcctaaaaaaattgacaatctatttgaaataaaaatgtcattacctatattccaacaaggattaaacatcgctgcaattgcacaatcaaaacttgcagcacaacacaagatgtattcacattatgaagtgttaaacacgattaaagagtctgttatttcaaattgggaaaatattttcactacaaattccatgctacaagcagctcaagattctgtgagatattcagaagtagcattattcggaataaaacaggaagcagagttaaatttaagaacagttctagatgtattagatgcagagcaagaattgctaaaagcaaaagtcaatcttgttaatgtacaaagtaatgtcgtgataagtatatacaacctacttgcattaataggacaactaaacattaattatatttaacatagaaatttatgagtaatactaacaattttcaatctattaaagaaacaattgcaaatattagaaaagccatgtctagcagcgataatacagatcctgtaactgcacaacatgatactgacaatgacgctgacaacgaagtacttaatttagaaaatccagaaaattctgtagagctacacaacatacaacatgtacacaatacattaaatgaaataaatcatacatttcaagcaataacagacttacctacaacaacatatcaaaataaaccagatatacaagtatctgtcacaaaagagaaaatttaccctgaacaattatctaacgtaaatcagttcatctcaattgaacaatcaactcaacggctatcatctcaagaaagaaggctaacaacaacacatactctttcagaagaagtatctaaaattgataacacatcagaaataaaaggtattcatcagcaaaatagttttatcactgaaaatttagtatcacctgaaagtatagttgcaagcagtgaagaaataaaaaagctaatcacacaaatacaccactatactaaaccccctaatatttcaagtgagaaaagtcctactgttgaagaactagtgataaacatgctaaaaccagaattatcaacatggcttaataacaatttacagaagttagtaaaggagattgttgaaaaagaaataaaacacatcataaagaaatcaaaccaaagctaactgtaggatttattaacttagtacacatattctattacttttctgaaatacaaactttttgagttattcatatttcacattctaaaaacataaatattaaaaacaactccgcataacttatctaaaaactgcatcaaggaagcaataaaacatatacaataagcattgccttacttcaatatccatttttcaacagcataaagatgcttaagaactatatgaaaaataacaattataggtatatttttacagcaaagaatttaaattatacaagtaatagtattttatttgaaacagatgtatacgtataaaaacactatgatagaaataatatcataattatttaatatattttttcaaacagcataatatattatctgtaatattatcataaattttacatatttcatgatctaatactaatgggtttcccagctctgctacattacatatttgaggatacaatgccacttccccaagaaaacttatgtttaacctatttgccattttatgtacaccttgtttaccaaaaatgtaagtcctacaaccagaatcaaaattaatgaaataactcatattctcgactataccaataatatgaacattcattttcttcatcatatcacatatctttactgcatcaataatagctaaatcttgaggagtagaaacgacaacaacaccagtaattttaaatctttcaacaagactaaggtgtacatcacctgtaccaggaggtgtatctattattaaataatctatttctccccacactgtattcatcattaaactatatattgcttttgttaccataggaccacgccaaatagcagcattatctttattaattaaatatccaattgacatacttttaataccatacttagtaattggaatcattttattactatggtctacttcaggattagtaacatctttaactcctaacatatgaggtatagatggtccataaatatcgagatcagctaatgctgacttataccctttacgcaacaaggataacactatattcattgccatggtagattttcctacaccacctttacctgaagatataagtattatatttttcacacctggaatcgatatcttatttgtagatatgcttttattgtgcttattaacagtatcatgtgcagcagtaaaaacaatctttacttctttaagattaggtatagtactaatcacatctctacattttttttcaatgatatttttttgttctatctgatacgcatctgacaaatttaatatacaataaacaacaccatcattcactaatacagacgttactaatcccaattcaacaatatttttattgctcttatgatcaataactgtcaataatgcatctaatacttcttgtttgtttaccactattatccttaaaaaagattaccctatgataacacatattattaaaaaatacctatttacttttagtaaaccattacgtattatcaggacatccattttacatatagattttttcgatgttaatatcttctggtacatctagtattaacttagcaaagtgcatatcaaacattacaagtataaagttagttaactcttgtatttctcgtttttctgatcaagaattaaacgtagaaattcaagaaaaccaagatgacaaaaataaacacgtcataattataaattcactttgttccccagcacatgataatttactagaattactcttgttaacggatgcaattaatagaacattgcatcctagaaaaataaccatgataataccttatctttgttacactagacaagacagagtaatgtatagaaacttagatgacaacagcctaatggtctctgcattaagtgcaaaagttatcattaacatattaagaacagcaaacattaacaacattatattcattgatctacattcaaatcaattatctggtttctttgacatagcaactactaatttaagttcccacactgttttcataggagatattatagaaaaacataatactaacaacttagttgttgtatctcctgactatggagcattaaacagaactcgaacttttgcaaacgtattatcaaaacagtgcaaattacacaacgaaattcaagtagcagtaatagataaatacagagcaaaacctggtgtatctgaagtaatgaacataactggtaatgtagaaaacaaagattgtataatagtagatgatattgtagattcagctggaacattatgcaatgcggcatcagctttaaaagacaggggagctttacaagttagtgcatatgttacacatggaatattatctggcaatgcagtagaaaaagttacgaattcaaaacttgataatttaataataacagacacaatacataatggtttcttcaacacatcaaaaatccgaattttatccattgataaatttttaagcaactatatactgtataatttagtataagtttaggaataaattgatagaagataaatttgaaaatagtacacattcaaaaacaagcaagtcattaactaaaaatgacatattgcaagctgcaaagttaactagaataaagctcaatgatgaagaaattgattaccaccttaaagaattagaacaagtgttaaattggatacaaacaatatcagaagttgatactcaagatgttactccaatgggtcatggtggtgtaaattatgctcttcctttacgtaaagatattatcaatgatggcaatataaaagacacagtattatcgcaatctcctaaacaagaacatgatttctttgttgtaccaaaagtaatagaataataaaaacatacacacaaagaattagagcaacacagaacatcataagtcaacactcaaaacactatggctattggtagaaacataccgatgaagaaattgattaccaccttaaagaattagaacaagtattaaattggatacaaacaataccagaagtgatactcaagatgttattctaatggctatagtagaaacatacaagatgaagaaattgattaccatctcaaagaattagaacaagtattaaattggatacaatacccagaagtgatactcaagatgttactccaatgggtcatggtagtgtaaattatgctcttcctttacgtaaagatattatcaatgatgaatgacaacataaaaagcatagtataccccagctttttgacaaaaatatatttgctatattaaaaatgcttgagaataatatgcacctcatagttttgacaaactgtacacacttgatcttatattgcaaggtatataaactccacttgtgcaatactggcttataatatacctcttacaaaataaacaaaaactatatcagcatgtatcttttatgctcttcctctacgtaaagatattatcaatgatgaaggcaacataaaaaacatggtataccccagctttttgacaaaaatatatttgctatattaaaaatgcttgagaataatatgcacctcaatagttttgacaaactgtatatatttgatcttgttacaaggtatataaaatccacttgtaatattggcttataatacactttttcacaaaataaacaaaaactatatcagcaacactaatggaattttataacttgtatctttatttcagcacattctacagaacttacgtatccgcattggatagttacagtattatgctccagtatactaactaacatatattatatgtagtacttgcatacttctacatgtccaataattcaaagcttacatttttttactatataagaagtacatcaatacatagcatattatacttctattcttctaatatttttagacccatatcgtgacttgttgtagtatttatcaacaacatcctagttcaatactgtaaaacaccaccacttttaaaatagccaactttaatagcattgagattacaaattaatcttatacttctacgagtttcttttctaacaataatacattctacttcctgattcataccaatctcaccaacaaatgtcatcacataatagcactttgcaccgttcagtagcaggtaaaacatattactttattttttttgcattatatagtgtatagatcagcactattaagtttatggtgtttactacaataacatatattataaaagtttagctggacatcatcttcattagtacatactgtaaaacaccaccacttttaaaatagtcaacttcaatagcagtattgagattacaaattaatcttatacttctacgagtttcttttctaataataatacattctacttcctgatttataccaatctcaccaacaatactaatttcttcatcacctacaagatttaaagttttccttgtatctccctcttcaaagattaatggtaatatacccataccaataagattagatctatgtatacgttcaaaactttcagctataatagccttaatattcaaaaagaaagtacctttagctgcccaatccctacttgaaccactaccatattcttttccagcaataacaaccaatggtatgttattttgttgataaagttgtgatgcatcaaatatcgacatttcttcacctgtaggcacatatttagtaaaaccaccttcacaacttaccatctcattacgtacacgaatattagcaaaggtaccacgcgtcattacgtgatgatttcctctacgtgagccatatgaattaaagtctgatactacaacattattctgcattaaaaacttacctgctggactattttcagcaatgttaccagctggagaaatatgatcagtagtgacactatcacctagtaaagccaaaattctcgcgttattaatattaagattattattgatatccatattaggagataaatttttaaaataagtagggctctgtatataagtactatctatatcccatgcatagatatcactatcaatacattttaaatcttcccaatatttccctccatcaaaaatattcttatatttatcaacaaacatttgtttattaatagtcttacaaataacttcatttatctcatcattagaaggccatatatcatgcaaatagatatctttgccatcatcatccacagctattggatccaaatgaatattaatattaacagttccagctaaagcataagctacaacaagaggaggagaagctaaaaaattagcttttacacaaggatgtattctcccttcaaagttacgattaccagatagtacagatgcaactaccaaattattttcttttatatttttctcaatatctgaacttagaggaccagaatttcctatacaagtagtacatccataaccaaccaaattgaatcctaatgcatttaaatctttttgtaatcccgacttaaccaaatattccgtaacaacctgtgaacctggagctaatgaagtttttacccatggcttagattttaaatttaacatatttgctttgcgcgcaacaagtcctgcagcaatcataacactagggtttgatgtattagtacaactagttattgcagcaataacaacatcaccatcctgtaaagaactttctgctaaattaactgttgatcttgaatttggcaataggttctgtaacgttgcttttacttcagaaagaaaaattttatcttgaggtctttttggaccagcaagtacaggctgtactgtttccagattaaactctatcttatcatcataacgtggctcttctttggtataccacaaacactgctccttagcataggattctactaaatctatcagtgataaatcacgtcctgtcatttccaaatattctaaagttttattatctatcgggaaaaaaccacacgtcgcaccatactcaggagacatattagcaatagtagctctatcagcaatggataacccacttaacccatctccataaaattcaacaaactttcctacaacccctttacttctcaagatattagtaatagtcaataccatatctgttgcagtaacaccttcagacaattttcctgtcaatttaaatcctataactttaggaatcagcatagtaatgggctgacctaacattactgcttcagcttctataccacctactccccatcctaagacagataatccattaatcatagtagtatggctatcagtacctactaaagtgtctggatatactaaattttccttatcccatacaactttagcaatatgttctaaatttacttgatgacatataccagctccaggaggcacaacacgaaaatttttgaaagcattctgtccccattttaaaaacctatatctttctaaatttctttgtatttccatagatacatttttattaaatgcatcctcttttccataaaaatcaacttgtattgaatgatcaataactaaatcaactggtactttgggattaattatgctaggatcactaccattttctcttacataatcacgcattgcagctaaatcaactattgctggtactccagtaaaatcttgcattaatacccgagctggagaaaaattaatttcatagcttacatgcttattaacacattgtgctaatttctttatatcttcaactctaacattacgaccatcttcattacgtaataaattctcaaacaatactttcaacgaatacggcaacttagtaacatcaacccctaacttactagctgcagttcttaaactaaagtattcataacaattttttcctgagactaactttttcttcgcattaagagaatctaaaaactccacactatacactccttacttttttacctaaataactaaacatatcaatagaaagtttagtatataccattaaatctttaagttaaagtatccttagcaatttctcatttatgtttaggataacacatattacttatcaagatataaccttctactatttaacctacgctaaacaactcatatgagtagcatacttatcttacactataattttcaattaacgtaccaaaaacgtcttttttaatatattgcaatacattattcactcttaagtttgagtgaaggtaaatacatattaaaccatatattacaaatttttattaaaaattcagcaaaatatctactgaagaatgcactcactgctgatagcttgttacttaaaggcagattactaaaaagacaaaagcattaacaacccatttaaagacttttgtaatacttcaaatttaaactcaagcaatcataaaagattcattttaactacagatgcactttatttaatagggactacaatacaccctaaacacacaacaccagtaataaacaaaattataaaaacattaatgtggctttgtattaacataaggactatctagcgagaacatcggtatactaacataaaaaacctgtgcagcatcttcatccataaattgatattccccatgcatcataccagatggagtacttaaatatgcaccactagtatactcaaaaaactctccaggttttaatacaggctgtttacctattactcctaaacctgttacttcattaataacacctgttgaatcaatgattttccaacttctcctcaagagctggactgtagaattacttttattcttaactctgatgttatacaaccatatataacaattttcatgtggagcagattgctcttctaagtaacttggaacaactttaacttcaataagtttggtcatactataatattgtagtgtcataaacaacccttagctacataataaataatacatcaatttcaccaacatatcaacacacaatacctgaaatttatgattcgaaataatcaaaaatactgatcacaatcattaatagttacaaacttaccatatacaccatttcaattctacacaacttaacgttaacactataatgaatacagagcatacttcccagtgttacaaaaattacacaccttattatttaattgacttgtttttttgaggcagattattattaactttgaaaatacaacaacagtaaattgatcactatgctacacgattcatacatcggccctggatcaactattgggattataggtggaggacagttaggaaaaatgatatccattgctgcagcaaacttaggatataaaacacatttattaactaataacccggatgatccatcagtctacattactaacagtgcaactatatcacacaattatcaaaatacagaatcattgcttgagtttgcatctaatgtcgacattgcaaccttagaatttgagaacattcctactactactatagatatattatcacaaaaaatcaaagtttatccaggaaaagaagctttatacatttcccaaaatagaataagagaaaaacagcacataagaaatttaggaatcaaaacttcagattttagagtaattgataactacaacagtttagtcaaaaatactatagaactaggatatcccaccttacttaagaccacagaattaggctacgatggaaaaggccagtatataataaaacaacaagatgatttaagtgctttatcaactctcaattgggaccaatcatatattttagaaaaatttgtcaaaatttataaagaaatatctgttataataacaaaaagcatcagtggttctatagaattttttccaactgcggaaaactgtcatactgatggtattttaaccacatcatcagtaccagccctaatctctcaagagataaatgtacaagcacaaaaaattgctttacaaattgcagaatctattaatttagtaggtttattagcagtggaatttttcataacagatacacaagaacttatagttaatgaaatagctccccgccctcacaactctggacattggagcttagatgcttgtaacatcagccaatttgaacaattaataagagcaatatgtggattacctttaaagcctgtaaaattactttttccatgtattatgaataacatattaggagataatatacacaactattataaacatgaaaccaaggttaatgaaaacttatacatatacggcaagaaaaaggccactaaaaacagaaaaatgggccacattaacacattaaaattcaaccagtaaccggagcaactatcattagaaagtttagtttcacaatacaaatattcacgaatttataaatgaaataataaactacacagtacaccaaaaaaagcaaccagaaatacactcattaagagacaacattctcaactatttcgaaatcaaggttaatgaaaacttatacatatatggcaagaaaaaggccactaagaatagaaaaatgggccatattaacacagtaaaattcagctagtaaccagagcaactatcattagaaagtttagtttcacaatacaaattattcacagaatttataaatgaaataataaactacacagtacaccaaaaaaagcaaccagaaatacactcattatgattatcatatcaatacgtaggccatagactttccaaataaattgataatacacaaactacataaactactgataccaatcttcacaggtaatctttataactataccgcctgcttctttcttagtagattgagcattaacatctgcacaacccaccagctccaaaataattactattattttcagctaaaagcttccctgagttacattcattcttacctatttcctcccacaaaacttctgtcataaagtcctgatatggtataaatcttattctcttaccatctggtacattctctgattgataatatacaaatatacaaacacataacctattgataccaatcttcacaggtaatctttactataccgcctgctcctttctcagtagattgagtattaacatctgcacaaccaccagctccaaaataattactattattttcagctaaaagcttccctgagttacattcattcttacctatttcctcccacaaaacttctgtcataaagtcctgatatggtataaatcttattctcttaccatctggtacattctctgattgataatatacaaatatacaaacacataacctattgataccaatcttcacaggtaatctttactataccgcctgctcctttctcagtagattgagtattaacatctgcacaaccaccagctccaaaataattactattattttcagctaaaagcttccctgagttacattcattcttacctatttcctcccacaaaacttctgtcataaagtcttgatatggtataaatcttattctcttaccatctggtacattttctgagtgacgggttacataattattaactattctataatataacatcttcttatcatgaactaacttattactttttatcctttttttcatatcattaagtaatttcccagctccattcgctgtcaatttcacctcacaaacttcaccattatgtgaatatttatctctcttacaaaattcaatcatagcatctgttcctacagtatgctcattgtcaagaacttgatcacgaataccttgtaaatgtacttttataaaatatttattagattttcctgttttaaacatacccataacatattcaccaggttgtccttcttcacttttccaattttctatatcaattttaccagattgccctccactccagatttccacttttacaaagtcacatctgctaggcacattatatacatcagttagctttggataacgcagtaatacatccacatgcttgtcattttttaactgttcctgaaacttcaacaaggcagaatctaaagtattatcatgtggtgcaattttttccactgcatatgttttactttcaaaatgatcaacacacatccccatagaatgataatctaaaaactgcagttcactttgtaattttgtatctaaagacaacatctttttatggtcaacatcaaagtatctcaatacacaagcatcaaatctattagctttggtaaactgagttaaaatctcaggatttgaaaattcactactttctagctttaacttcgcattttggtacaaataatatgaattttttaggctattacaaggattatcatctggatagatattggttatcctattgctatactgttcatcaggaaagaaatagtaaccatctccatttatgaaaagatcatctaaaaaatcctgcgttttattcgttatatcatattcataatcagcacattgaatatattttttctcatgtacacgtacataacgtaccattccactcggcaaaggtttaagccaagtgtgtttatcgtattcttcatatttctcacgagacttcaacacatatccgaaaattgcgcttataccatctacacattttactgtaattttattatcatgcttgtatcttaccctacttacttcattatttccgcaatattcatgtagtttcaagattttcccattttggcattgctcgtacaaatagaagtcatgactattaacatcaattttaggccttacaatatcaacattaaaatcacgcataattctattatcaataaggttacctttttctgaagtcattacatcataaaatcttatctccattgtaccatttttatgttcacttaactttagtttagacaatacaggaataggaacacatttagtcataaaattcccttgatcataataactagcacatattagattatgtcctgacctatatattctaaactcatacaactttccagaaaatgcaactttataatctccccctattacatcattctcaaataagaaaaagtctcgtttatacaaacttccattatctactattataagtctaatacctggtttaaagaatgtctggcgcgaaaactctactggtacaaatcttatgctatttttctcttcaagtaataaaggacaaaataccataggaagtggttttgaagatattttttcacacattatactagtctcacactttgtaccccattctgattggttaactggcaaattttcacaagaatatacttgacacatacacagctttggatgcataaaatcactttcatcaatataagcgatacagtacattgaagatgatcctacacttttacactcccctgcattaacagtagtttcaaaaaaaagatttgccaattttatcttatcattacaaaaacgtagagatttataactcagactaggttttgcattaaaaatctcttcatatccaaacacacatgtagtacccacacaaaatgtcaatataaatatatataagactccttttacaatattaaaaatatgcctaaacataaatatatatacttaaatagaaaagaaaattatagtaatgcttaatatgttaacataaatatttattcatattaaccatattttataataaatataatatataattaattatttatttaagtttcttaaaaagaagactaatataatgaagtaatttacttgtaataaacttgatatacaacaccattaacttacttctagatagttagaaatactttcgcatcaggtaatgccaaacacaactattacctagtacaacacataaggttctgagcacattaacccttatacaaattcacatatttacttagtgctacagctacttttttgcttgaattggtgttgcattcttcaccgatgaactttttactactttcaccatagtcttattagattgtttgtctacttgttctctaacttcctgcggcaacctatagtaacctagtatttgccatatagttctaccaaccttccaacaaacaggatttatatctagactaaaaacatctttaaccttagcacggtgatggtctcttatatcactataacaacacgtataatcaaaaacctcactactactgctactcttactataacatgataacgcaagattttcactagctatacatttagtcatttttccattatgataacaacaatggttatcatttggacatgacactttaatactttcacctattttactattatattttacatctacagcactactaggcaaacaagcatcagaactctcaactttatctctaactaatttataactatttggaccatcaaaagttccacctttagaataaatacataaagacactaaacaccctttattttttaccttatctgtagtatcaatacaaaacgttttctcttcaggataataagcatactgtagctctactcctttggtttcctctaaattcaaatttatatcaagttgttccttagataacggcttattatttttccgctgtgattttgctaatgttaaaaaaccatcagaagatccaaagccagcatatttttttgcaaaaacacgtgttttttcatcttttaatccataactttccaatgtattatagttatatgatttcacatctgtatttatttttaaattctctatccttatttcacttttaaatggataattcattctctcttgaaccaacattcccatagatacactatcgttattctgtataggataagtaccaatagttttcagatattgaatattgttcccaatactcaaataggatacctgtttttttacactattatcaccttctatagatttagtcaccttctcaaaattctcaactttttctgttttatgtttctgtgtttcagctgtattagaaatcggaggtaaactagtcagtaattctttaccaccatcatcaaaagtttccctaagttctataggcaaagtactgtaattaaacattttcagtatattaacacctttttgtctccaacaaatatctttacgatgctctgtatcttgtatattatgataacaacatacatatttatcctccgacatctttaaatggctcatcctatttctatagcataacaaactcatattttcatgttcccaattttgccaacattttatacgattaacacgcagtccacctgtagcataagtataatctgcattatcaaaattagacatataaccagtaactagagcttggtgattgtcataacaatatttactatcactcacacgttttatagtcatcttatctcctgcagcaaaaatattcacaaaaagatgatgctttctttcaacaagaggttcacatttttcaccaaacatagtaacaggagatctaaacttcatatattcattatctgcagaatatatacaaactgactttaaacatccaccacgaccatttacacatagtgaatttttatttttattataaatatagcttgcacttttttcattctgtactcgtttagtagtattaccactccacatctcacacgttagtcttactaacccatctgcaccttcttgaattgatttactgatattagcacatcctccagaaccaggatactgatttgggttcttttcaaatgcattagctggtcctgaacaatcattactatttaatctaatagtaccagcaggaaactgaggatctccccatggaataaatctataatactgtaaccatacaggcctttgtctagaaaaatccataccagtagcagacctataatgcattacaatatcatcattaataaacgagtgattcttttgacactcattatgagtacatccacgagctacaaatgaaacattacaattactattaaaactaccagagtcacatagagccactactgtatcttcaccatattctcctggatagctgcctccttctccaacatatattactaattttttcccttttagtttaccattattagttcctaatataccaagagtataatgagcaggagccccagaataagctttaccatcacttatatatccagcttgacctcctccccaagcttcaacttttataaaatcacactgatgataattacctatttcgtatacatattgttttgtcttggtaccatctatatgtttctttaccctatattcatatttagggaaatgatcgacacacattttttcaaaatacaagtttctctctactaatccatctaaaactccttcattttgtagaataaaatccagattttttaattcactcctatttctatttggaccaaaagtttgaaaatcatcacttgtataactatataaacaactcttactatattctctgtcatcagaagaatattccaatttcccaaaaatacactccttagcatctttaacatttttaagataggttggaacatacaaatataattcactattcccacataaattttgttttgtatttcccttatatggagcaatacgataccctaccctaggaatagtatagtgatcaccacgaactttaatagacgttacaaaagatctcatatttatattatcaagatcatagctcatactatcatcacatgggtaatataccccaccatcatatatatgacgtactaacttcttcttatttaaccttaaccaaaaatatctatgtcctccaatagtttggtcatatctttttatataatacccttttcccgtataatttaatcctgacagacatgttatattattaaatacctccttagttgcaattttctctacagtcttagtacattcaatgcgatctccccgcacgttcccatcaacacattcagttcttgtttcaaattcatgagttttcaagttcatctcaggctgaattagatcaacagatttaccaaatacagcccttaactcttctgctgtcatttccttgacttgttctttataatcacgaccagtagcactatttagattgccttcaactacacttttcaccttgacttcagcaacaaatatttgatctttttttcttattttaaacacaggacgccttaacgctggtatcggtaaacattgctttatacattgtcctctactattataataaacacacaagccatccataccacttctatgcatcccataatacataacaccataatctgccagactacgattacttttaccatttgccttagacatcatagacttgaaatctacatacaatgattcaccagcttctggcacaagtttcaaacctttagaaggatgcataagaaataatttaggctcaaaaaatgactgcatataaaatggtacaatacgaaaatccagaactggtatttccttgaatatagtgtcacagaaaggataaggatttttatcaatttgatctaaagtataaaatgtactaccatcaacacatgcagataaactaacataagggaaaacaacacacaaataaaatattacaagagctatcttttttaacacacactttaccattgaatagaagacatacacttattcaagtatatatctaaaattgtatattacacaattaactatctacatggttgtagacctatctacccaaaatacaatcaatccagcgctattcagtgaaaaatattctataattaaaaattacatcatattttaggatatatacagttaattagtaaattgaagtaccgctaataaagcaagtaactacttcaattaaaccactcaaactttcctataataacaaaatttcaatctacacaccttgcacactattaaaattttctttttccctattgttaataaattgttgtatataacattacacatgctatttacagtagaaactcttatatatagactaaaaattaatcaacagtttttaaaatatataatccacatttataaaactctgttaactattaattaatatataaaaagtggtaactgcttaaactacaacaaaactacaagtgtgaatgatataggtaacaacattcccttataatatacttaatcaaacgcaacaatgttaaactaaaatattactacaactatggataataacattatataacttattttataaagaaatttgatgaaaattttcagtacattatttttacaaatcagcaaactttataaaatagctatttgtattgaaacacacaccttatgctatattaaccaactacataaaatggatgattacttctcattaacactattgctacaattctacagaatacatataacaacctttgataactcttacaaaaaaatctcgataaattacaatgttacttcttattattcctataaatcagcaaaccctataaaatacagctacattacatatataaatggataatcagtattattgctacagttctgcaaaatacagataataacctttgataactcttacaaaaaatcctgagaaaattacaatgttacttcttattattcctataaatcagcaaaccctataaaatacagctacattacaacataaatggataattagtattattgctacagttctgcaaaatacagataataacctttgataactcttacaaaaaatcctgagaaaattacaatgttacttcttattattcctataaatcagcaaaacctataaaatacagttacattacaacataaatggataattagtattattgctacaattctacagaatacatataacaacctttgataactcttacaaaaaatcctgagaaaattacaatgttacttcttattattcctataaatcagcaaaacctataaaatacagttacattacaacataaatggataattagtattattgctacaattctacagaatacatataacaacctttgataactcttacaaaaaaatcctgataaaatttacaatgttacttcttattattcctataaatcagcaaaccttataaaatagctacatcacatattaattttatacgtactttatagacgataacattttcatatctctaacaccacttataagtatctattgacaaatagtactgcttttcaactttcactaaacttatccatactcttatgaaattttagtatatgtttttatctataaaattccattcattgttttaacaagtagggtaattttctaatattctaatccccttccagcattaattttatcaaaggctccatatcatcattaaatgaagcaaggcacgaaatacaagcccacaaagcaacgacactagctctataattactatattctccatatttcatatgactaacacttcgttgcaattgtgacacagtaccataaggcaaacaatgagcagttcgtgacaatgaagaacgcacatctgccaacatagagtttacctgagtagtactaaccaataaatcagacattgcatagtttaacatcattacattaatcaataaaagcacttcttgttgaccatttgtaatgcctaaatccctaaagacatcatagttagaataaatttcctgctttaatttatgaagctcattgcttatttctcgtaatgtcatatcggaacattctccacccaaaccccctcttaatacacagtgcattacataatcatacactcgttgtttatatgtatacaaagattgcataccagagaacttacgagcaaaatccccagtagttatttttcttataaaattgtatacttttaaaggcaatttttcactatatcgattcatagatgtaaaaaatactctttctgcacttgtacattttccccatgctcctatttcaaacaacaacccagcaaaagattgataacgtttaaaaagccattttgacttagaagaagcatatgatatataagaccacaacgcgattatatcagttctatgaacaccatgtactccatattccatattattagcatcttgctgcaacttaataatttcatcaactggaaaataattttgagcaaaagatattttaaaagttattttgtatcttataccttgagacaaactacgaccattatttgcattattagaactagcattacgatgcccaccaactaatgacaacaattccttcagttgactattatcaatttttatttccgatactaataaattgaatatgactgcatcaatacttaaaaatattgcctcttgactgcttgtaatccctacatcagtgaaaattttatatatatctggattattcaaaaggtctgcaatgttagaagataactgccttacatttgataaaagatttccaagataagaatatacatcatttatgtttgatactcgtccattaacaatattagccacagagtcaacctgaaatacacttccaacacgcaatacatttctcaactcatttgtatagttcattaacgcaattcctaattctggaaataacgacattttctcacagaaatttttctcacttattttctttaggaaatctcgtaaacttaaaggcaatttatctccataagtattcaacttattaaataaatcaaccacatcattatcacagcctttcagatctataaatttcaagtctatccctaatagtaattttacaaaagattcacattttttaatactccatccagattcagaagacatatatgatatataagaccacaatgcaattatatcagctctgtgaacaccatagtttccatattccatgttattagcattttgctgtagcatcaaaataccattaccaggatatcgattctgatcaatcgtaacctgttgtatctgacctgaacctttactacgttccaaccttatattattcaaagcaagactattatcataaatcaacaataacaaattcttcagttttttctgatcaatttttatttctgataccagtgaattaaatatgactgcatcaaaagctaaagatatttcttctttactgctagtaatacctgcatcagtaaaaattttatatatctctgggttatttaaaagatttgtaatgttagaagataattctcctacatctgaccaaatatttgcagcatgagaatataccttttctatatttgataacttccctctatgagcatagtttagatcatataaagaactgaaatagaacaaattacctccacgtaattcattaagtaaattttcctcatatttcactagtgaagtttctaacgctgcaaaccttgatattttcttacaaacactctctttacttattttatctaagaagtcttgcagcaccgcaggtaatttacttttgtacttgtttaacttatcaaataaataacgtaaattatcattacattttcttatcttcacagatgtcagatcttctgccaacagtaatttaacaaaagatttaaaatcttcaatattccattcaaaagaattgtatgccatgtaagaccacaatgtaactatattagctctatgatcaccatatttcccatacttcatattactagcatcttgtcgtaactccacaatagtatcataaggaaaattatcaagagcctgtgatgatataggatctaacaacgataacgtactagttatatcagaattacccacatttaaatcagacattacataatttaacattactgcatcaattaataacgctatttcttttctattacttgcaatacctatatcagtaaaaacttcataattaagatcaaccgcatcctgtaacttcttcgccatagatcctagactgctacgccacttactttccagacaacgcttatccgtattctttaatgcacagtcaatggcataatttgacaactctacaccatatgaattcaataattccatcttagagaatgtattacaaaaatctccagtagctattttttttataaaatcttgtatctgtgaaggcaatctttcactatacttacctatagattcaaacaatctgatatgtgtatcactacagtttccccacttcataaatttattcagatccattcctagcatcaattcaacaaaaggggctgcataaagctcaaaaagttgtctatcagacttaaagaaagtatacatccaagaaactacaatgttgttctttttatgcccttcttcatctgtaataacacttctatgtatcatattaataaaatttctatatcgtcttacaaattccggatctttcaactccacactaaaccactgttctggcttttcagtagttacattaaacatcattgcttcattgtcagacaatttatcataatcctcatcatgttttgaaagatcatagtcaaattcattatcagaaacataataatttaacaaacctgaaggtggatttgatatattgacaccaaaattaaaattcagtacatcaaggtataaaagtaatgtttcaggagactcattaatccctaacttagctaacattgctttaacttctgtattatttaattcagtaaatagctccttacgaagacctgataaattatgacctaatatatctccaccaaccaatatcttatcaattgcaataaaatatttactcatactggatattaaatttggaaaactttttgattgcctacaaaagctaaccttacttattttctgcaaaaattcctttactacatttggtataccagatgttgacttgtgcattttttctattaatgtaactaaaaaatcactgcatgcattttcatctattaaacttattttacctacattacctgaccatttttcacaagttattctgaccataccattagcaccttcttgggcacaattataaacactagaacatccaccagccccccagtatttattagaatttttctccaaaatattactatcacataaacactctttatctcctttacgtaacttaccataaggcatatccggactttgataaggtactaatatttcactttctcctgaattctgtaatccaggagcaaatctataatgtactagattgtcaatcccttcggaactatcttgtaaataattaccgccttcatcaccaccatgcgctattattttcactaagcaattcttatcatcatcatcacacaactttacagtggtatccccaccagaattacttaaagaattcgctcctttacctccatcaccaatatcaattatcaattttttattaactacatttttatcaaaccttaacaaccccataacataattaccagctttaccagacctaccagaccttgatatcccagatgctcctcctccccatgcttctatttttaaaaaatcacattctgtatttttctggtcaatacccaatttataagaatctggtaatatcttccttactaaaactcttttcttatattcataagaagggaaattactgacacacataccttgtaagattggattcagaggtacaattttttccaattcatcattttcatgaaagaaatatgtaaaatcatcatcactcatataaagtgaactacatccttttatcttctttgttccataatccaattcaaccatattcttacaagatacctgtccacctttttcatataatctgttattttcatacctatatagcatactgtcctgacacggagcatttttaggattgtagtggcctccaatatcaaaaaatgcatcttgccttattctagtaattttatttagctgttcttgtgtcatacttttaatatctattgcaaatttctgatcacattgcacatatctttcaacatcctttccagtatcagttttaccaacaacaactccataacccaatagcattttatcatgcatgcttaaccacaagtctctatgattctttttaatagaatacttcataggaacaaaaggcatatcaacaacacatgtaacattactgttattatcatgcacgtatccaagtctttgccctattccatttacacattgattctcattctcaacaattttcccatcttcacattcataccgactgagcaaagtgtaattattaaaatcaattttaggctttattacagaaaaatacatatcaagatcttgtgtacctggcaacatatcaacactacaactagataatccctgacaatcttgatattgtatattaacaccattagcattagaagttactttaggacgcatcaatcctggagaaggaacacatacttttttccctttttcaccattattactatattccgcacatactgtatcataaccagctttataaacttgaaattcataaggaattccagcatgtgaaatattataagaagttttatcacctatcttatgagatttcacatataactcctttgtataagggttaccagatcctgaataaatatgtattctaacaccaggtctaaaaaaagtttgctgagaaaatcttaaaggagtaatagagactatactagatgcgtccaatatgctacagaatggtggaggattaattgctacggttacctttttacaacgtatactttttttatcacatgaatttctttcaggtttaacattacactttcctacaaaacatatacagacctttgaactagcgttttcattttctaaaaatgctatagcactgacaggatcataaattatactaccagcatatagaactttacaaccacctataggtaaactatgaaatgtcacctttccccaataagaagacagctgcataaacattacatcatggtcatcaaatgtacgatcttccctattaaaaggtatatctaacccagaaacatttagattttctacatcctgatattgcccttttacatattgcataaaagacatatatctataactatcatgtgaagcaaatcttatcataacactatcaagattaccttccgtattatcgacaggtttataatagttatcaaaatgaagaccatagtaagtgttataatgtacattagcataatctctgagaacatgtatattgatcttagcatgtaaaagtgcacgtggataaacgaaagataataaaacaattaagtataagcctatatttttgtaacaccataccttcataaacacacttactaatcgttaataaaaaaccagcacaaaaatcatccgcactcttaagagatatctccaaacaagaaacaatctatatgaaatttccttcaatataggatagatcatgatttttatataataatgaaagttttcctctaaagcataaattatagatttgactatcataattattatagggaatatacagaaaattaataatatatatacatttcatctgcatattaccatataaaacacaataaatctattaatagaaaatgataaatatgatgtatcagtaattgttgaataaaaatttaacaacactttatgaagtttcttgtataatagacgataaaacagaataacagaataattatcctatatctgtgcataaaacatttgaatcaatatatggaacagaaattatattttacaatacatgatatgctatatacaaaatattatgattaatcttcaaattcttcatactcaacagaaatccatcaactactttaaatttattaaagcacagtttcccaaaattgaaaaaaataagtaaattttctaacttccatttttttatcacaaacaagcttgtgatcaacaacttctacaaatgttactaatattatgttaagtccatttacattgcataaatttcatacagtgtaaaattttaagctccacatttcttataaaatgcaggcagccattctcttacattatccccatgactactaatagattcatacatataccgaattgtattcttattagcagaaagaacattagtttctggtatatttggcaaattgaaagacaatactactgaatcattatcctgctttacgaaaaaatatccttcctgagatggcatttgaaacatagtattacattctgactttgatagattaaatgccctcatatacattttattagttgatactgaatttggcatgaaaacttgtgtttcaacatgctgattaaacctacaaatgatattactggaaataatagctggaatgttttcaccagcaaatacaacaacaacatttaatttgttcatcatttcaatccactcatcaaattcctgatcactagtaaaaacataatccaaaatccatgcttcatctattactaaaaccgtaggagacccatcaagataattaattaaagcatgcaaaaagtaataaacaataacagaagcacattgaggtttagagaacaaaataccaatattcaaccctaaaacttttgctgcccaatcaatattagcatcttcctttagtaaatgcgcaaactccccattatttaaccattgactagcattggtacccagtgtactgacatggtcagcaatactatttatagttctagactcaagaggcaacgtaaaaagatcattaactattctatctattgcactattaacttcctcagttatgtttttaacattcaacattctttgcaaaacaccagtaacgattctacgattaagtgcagtatcttcaacttgaaagaaattaaacgacatttcctgataatcacgcctatggtctgctctataatactgaccacccatagccttaacaaaaacaatagacttaccagtataatctagcaagacaattcgtgcattcaactgcatagattctgacaataaaaagttcagtaacatagtaactgaagattgaggactaccaaccattaaagtgtgtcctttatcaaacacatgaaaactaaagaaataaggtttacccttatttgaaaaaaacatagtaattgcttgtccccacttgtttccttgaagtgctcctgaagggaaataatgcaacaacgaaaatgcacaagcatattttattaacgtatacctaaagtttaaaatataagaaaaattgccaggtaaatgtgcccaaaaatcatcttccatgctcaaatcacacctgacacaaataataccaagtgaagacaatgaattaacagccctatctatattattatgaagctgtggtaaagtatctgacattattacaaagtttattttgcgttcgcagaaacttaaattagagtttggatcaactgatacgaaatcatctatattggataactttctcaactgaaaatcattgctacattctaaaaatgtagcttgcttttgaaaaagctttaatgcattcttactttttgcaaactttataatttcaactacgataaatccataatcctgctgtagacattcatctaccgcatctaatggagaatcttgataatctttaattgctaatattgcaccaaatctttggttattatcacatgaaattttaaatgtattaaatcccatactaatactacaatgactacatataccagaaatatctaccatatcaaggaaacattctttatgatgcatcatagttaaataatacaaaaactctatcaactccgatcttactttttctttatcaattactatcaatcctaactttctgacttcaaactttttcaaattttctaaaatacttgcagtgaccttatttaatctgtctattttattttttaaaaaatctttatgcttattttttacataggagaatgacagagcacctaacactcctttcatactttcaggtaagtgattagtaaccactgctatatataactcattaatataagtcacacgttgacctatattattaagatgagcactacctaaagcatcagaaacatcgtttatactttttcttgcaaaatcaaacttatgtggtttccttacagtataaatccaaaaagaaacttctggaacttcaacactattaactatactattacgcactactgttcttaaatctttatcattaacataatgagtaagtacataatcctctatctttattatttgtacaagttcaccatctttattcaatattgtattctcatcataatgacaagctgcaggaataaaatctcctttactagaggtattatctcgtctttttctagaaaaattattcatatcagaagaatggccgatcatttctttcacaaaagacatacaggaaacccttatttaaccctataacatttatataaatatccataagtaaaattaacatctatataggataatatctgctttaatcatcattatctaaatacaaaattaatattttctttatgctacaattaaataaacaattaatgaactaccctattatgaaatttacaatgcaaaaatcaagaatctcagactcatttttacatagatggcattcacaaatttcaatccagcattatacaaaaaacaaaatcaactctacatttaaatctatattagtactacaagttgaataaatacaataacactctacttgaataatacaaatttaaactagcattagccaataaatattcaccgtcttaacataaaaatcacttactaagaaacacatataaaacacggactattagagaaaaaaacttatgtgatatacaaaaatataacagtactaagatgtaaaattgcatttagaattccgaagtaatccaatctaaaaacgatgtaattaagtaagcaatagaaaattcaatatataaacacccaaatattcccacaattcattgattttctaaactattcactataatcaaaattacttatctactcatctatgaagaacaagcttaccaccaattcacaaacaaaactacctaatgacaattaaaaattactattggattatactgattttttaatcttgagaatactaacagctaggtaatccaagtattactgcttataacaataaaaataccagttaaatacttaaaacccatatataatactgtatcatatacaaattaagcagcaacttgaagccttaaattattgcaagaatacctgagtaaagctaagaacgaaaattacatagatcacaatattccataatcactgtattcttaactttcaaaacccatcacttaacctggctacttggcgttactaaagcagaacaatcttttacattagtcatattattattcaccccttcaacaaacttagtaattaattttcctgctccaaaaaatatcgctgtaaatacaaccaacattactattgctggccatggcaattttccaaatattgccataatgcttgagccaagtattacccctgtcatgattggcaatcccaacttttgcacaaactgtataacattacatataactttacttacatcatctgaatcaccagtaccagcttgctcgttagcatatgcacctgagtaacacaacggtgcaacaccaacaaaccctactattataaaaaacactaaaacaatttttaacataaggctctcatttatttttttgatggagtagtactacaatctgccccactagtcatattattattaattccactgacaaacttactaactaatttacctgcaccaaaaaatattgctgtaaatacaactaacattactattgctggccatggtaaccttccaaatattgccataatacttgaaccaagtattacccctgtcatgattggcaatcccaacttttgcacaaactgtataacattacatataactctacttacatcatctgaattatcagtatcagcttgcttgctagcatgtgcacctgaataacacaacagtgcaacgccaacaaacctactattataaaaacactaaaacaatctttaacataaaggctctcacgatgattatttagtacaatctgctccactagtcatattattactaactccattaacaaacttactaaccaatttacctgcaccaaaaaatattgctgtgaatacaactaacatcactattgctggccatggcaaccttccaaatattgccataatacttgaaccaaggattacccctgtcatgattggcaatcctaacttttgcacaaactttataacattacatataactttactcacatcatcatcctgactaaccgtgctagtactactattattatttgctgcagcactagaaaagtttaatgacataacacctataaatcccacaattacaagaaatacaaaaacagcctttaacatataacttataccttacatgaattttcgaaacacctgaacaattctatatatgacataccttcaactagtaatacattaccaatcacacatgttcagtaagctaatagcttacctcgcaaatatgtactgtaatgctactcatactaattcactgatcttagtaatgcctaagcctaaatattctaactaccaatataaacatcagtaacttaaacactaaagcaatataccatatataattaaccactattgatcacagccacaatttatgcttctctcacaaactctatagtagtgctattaaattgcatatttgacatgctttcttaatcttattgttcccaacaataaattagactacgcaattttcaattcacgtttgcaaaaatatcatgggtaaaacgtttatactaatcattataaatgcagtatatttactacaattttcctgatatctactttataaacatatccattatacactattaataacacactcatagtttttgaaacaaaaagcgttaaaaatcatagtgattataaaaagttttctatctaattttatacatcataaccccatcaacaaattcccctgctatcaaaataacaacaatgttgatatactaagaatttacacactctatctcaacctactgttgtataagttaacctaagtacaacacaaaataattaacatattgtaaattaatgatgcctttttatatgtgaatgtagtataagcatttattataaattggattagttgtcgttgtaaaaagcgatcttacaaaattagaaaataaagtaatgtaaaatacggaatctaaagttaagatttgatatgcaatctcatgacagaattatataaaaactttacaacaattcattgaatgctgagatcctaatagacatattacattgataaaatactgcatcttcttttattaaaaaaccagcaataaacccaagacaaactgtactttcaccactatcgctaaaatttcccctacaattgatcttaagttgtatatttaatcaataccctagaaattgctataaatcttttaaaatagggtacatacgtttaattaaaaaaaaaatgttactttagaatatattaaatttcttctactgtattaatctaaaactcattttgataaatatgtgacattgacaaaatactgcaccttcttttattaaaaccagcaataaatctaagacaaactgtactttcaccactattgctaaaatttcccctacaactgatcttagttgtatatttaacaataccctagaaattgccataaatcttttaaaatagggtacacacgtttaatttaaaaaaaatgttactttaagaatatattaaatttattgtatcatattaatctaaaattcatattctcacaaatgttacgtagaacatgtaatacgttataaccgctcagacattgcttatatatatctacgccttaactataacagaatctcttaactaaatgacacaaatcaccgcttgagaaaacaagaaaataattacaaagtattacacaaacacagtgacattaaaatttatacatacaaaataatctatccagtcattagctagataatcaaactgacatgcataactattagtgcacaataaactgtatcacaagatacaaaactaaaagtcagttataactaaagcagccacgtaaatattaacatatcgacaacttttagtataactgacttgttcaaatttattacatgtattcatctactaacttaatctataaagaattttcagaaataaagttactttatatcagaaacaacagatacaattaaacaaaaaaatacatcacattataaaccaattaaggaccttttgatattgaactacaatcaaacttatcagctgaaagttctgttattccaccagcaaatttagatatcagcttacctgccccaaagaatatagctgtaaacacaactaacattactattgctggccatggtagcctaccaaatattgccataacacttgaaccaaggattacccctgtcatgattggcaaccccaatttttgcacaaacacaacaacattacatatcaccttagtaactgtatcatctcctgcttgaccaccagtattagcatcacttacatttggtgctacagaaaacattaagagcagcaaaaatagaagagctctacctataaaatacttacttatattatacaccattattaatccctcacaaatttatgaacaacaatatcaacaaaacactctataatgtttattaaataaataaaagacttttcctaaaaattagtttatataacaatccattgtctgttttttcataaaaaataaaaacataactaggatatatactgatacaacacttacacataaaaactgctgctaacctaacttcactaaaaaatcttatcattgaaaatgtcatgcaacactttttcacttccctatacatttaaatatttaaaaagtcaattattattaatagtttagagaatcagactcttttactaacatttatacgaataaaaattaatatattttaattttattaagtatatttctagcattttagttaatactatctttataaaaaatattaatacaaacaattattatccaagtataccaattatcagtaaacagtgtatcagctcacaataaatactatattaaaaatacttaattaaaagatataagatattaatataaataaaaaatttatttaaagaatatcaaattattaatatcaacttcctaatatgttaatcactaaaaaaataaactttgacatacatgagtattttcaatagatttttaagatattgatgtataatgagggttttcttgatttttcaagagcttaatattgtggttttggtattttaatgttaacaacagttatgttttgttatatattagatacggtacagtgctgaaaatgagtaatgcatttagttaaataggtggaatagcttatgtttgatgattatgatccttggaatagtaataacaaagaagaccacaaatctaaaggatataaaaattccaatgatattaataaagttattcactatttcaacaatacatttggttcatttttaaaaaacaagaaaggcattcgacctaataatcatggaaaaacacaatttattatcgcatttttagtcatgatgcttctatacatggggtctgggttttacatagtcgaacctgaagaagaagctgtacaactactatttggtaaatatcatgacactgtaggtcccgggttgcgttattatctcccatcccctattggacaggtaattaagttaaaagttaaaacagttaacagggaagaaataggttctaggttttattcagatagcacttcaggccatggcgaaggtgttatgttaactggagatgaaaacatcgttaacataaactttgatgttcattggcgcatcaacaatgcatacaactacttgtttaaagtcagagataaccaagtaggagatacagtaaaaaatgcagctgaaagtgcaatgcgtgaagttattggaaaaagctctatatcttttgcaattgaggggaaaggaagagccataatatcacaagaaactaagacattactacagcatattctagatcaatataatatgggagttgaaattttatcaattcagctaaaaaaagttgatcctccagaaaaagtgatcaattcttttagagatgtacagagtgcaagagctgataaagaaaagttgattaacgaggcatatgcataccgtaatcaagtactgccaaaagctaaaggtgaggctataaaaattaaactagatgcagaagcatacgaaagtgaagtagttaacgcagctgaaggtaatacaaaaaggttcattgctctctataaagaatacgtatatcaacctgatgcaatgagaaatcgtttatatttagaaacaatggaagaaatattaaataaaaatgataaggtagttgtcagcgatgatctgaaaggtatgctttcttacttcccgttagcagatcctagaaatagtaggtaagtttatgagtaaatcatttaagttcatattagggtttttaactatcgcaacagttatcgtatcattaaactccatgtttattgtcgatgaagcacatcaatcaatagtcctacaatttggacgcgtagtaaaacagatacacaatagcggattatattttaaagtaccttttatacagaaggttgtgtatgttgacaaaagaattatcgatattagttctgactcaagagaagttatcgctgctgatcaaaagagatttatcgttgattcttatgcaaaatacaagattgtagatgccgtcaaattttatcaaacagtcagaaatgaaacaggattaaagaatagattaagttctatcatcgaatcaaacatccgtgaaaaaataggaaatgtatcacttattaattttctaaatgaagcaagatcagaagttatgtcagtgatacaagaaggcgttagcaaagagtcccaaaaatttggcatagaaatgatagacgtcagaattaagcgtgcagatctaccagaagaaaatagcatagctatatttagacgtatgcaaacagatagagaaaaagaagcaaaagaaatcagagcagaaggagaagcagcgtcacagcgcattaaagctgatgcagaccttcaaactcgtattatcatcgcaaatgcgatcaaagaagcacaaatcattcgagggaatggagatgctaaagcttcaaaaatttacaatgaagctttaaaatctgatccaaatttctttagtttttatagaacaatgcaagcatataagcatgctttcaatgggaaaaatacaagaattatcttatcacctaataatgattttattaatttgtttaataaagaaagaggtaaataattaatgaaaagatttctattactaatattagtactaatattggcaaatgttcctataggtagttttgctgatcagaaagcagaacaatatgatccaaggtcaggcttttctaaattaatcaaagaatctacaccagcagtagttaatatcagtatagtacatgatttaatacaggaacaatttcctttaataactctcgaagaacttttaaggaatatattagaaggcaagccagtaaaaaaagacataccacaagaagtattaagcgcagggtcgggatttgttgtagatgaatcaggtattatcgtcaccaactatcatgttgtacacaatgcaaaagaagtttatgtcacatttagtgacaacaagtcaattcctgctaagattttaggagttgacccacaaacagacctagcagtgttaaaagttgaagttaatgaaaaacttccttatctagaatttggagattctgacaagactatggttggagactgggtagttgccataggtaacccatttggtcttggtggttctgcaagtattggtattatatctgcacgcgcaagagatcttaacattggcacagcaacagaatttttacaaactgatgctgcaattaataagggtaactctggtggtcctctatttaatatagatggtaaagtaattggtattaacacagcaatattatctacacaaaaaggtggtggtaacataggagttggatttgctatcccatcaaataatgctgtttctataataaaagttttatcccaagggaaaaaagtagaacatggttggctcggtgtagtgatgcaaccgataactgaagaactagtagaaccattacaactaaaagaagtgggtggagctttaattactaatgtagtcaaaggtagtccagcaagtaaagcaaacttgcttccaggggatattatacttgagtttaatggtactaagattaattcaatatcacaactacatcaattagtactaagatcagaagcagacaatgaagtaaaattacttgtgtcacgtaatggtagtattataagtatactagtcaaaatagggaaatttgagaatcctgatatttcagaaaacggaatgcctaaggatgctatccaatccccggagttagggttaacagtaggtagtgtacaacgcaataacatatataataatattgaggaagaagaagcaaaaggagtggtgatattagatatagatagtacaagtaatgcttcaaccagaaatataagaaaaggcgatataatattacaaatcaatcaatcaccagtaaataatctcgaagattttaaaaatgttatgaaaaaagtacgtaaaaataaatctgtagcattgttaatcagtagggataatatatcagcttttgtgactgtcaagctgaagcagtaggatgaaaactaaaatagcatatatatatttttttatagtgtattttgtcagtatacatgcgtattcaactgaaacaataaaagaagaattactatcttattttagtgctatacattcttttaaagcagagtttgttcaaacaagctctgctaataacgatattcagcatggaatggtatttatgaaaaaacctggattattaaaatgggattattatccacctactccagcttccattataatgcacggtagaaccatttcttactatgataaggaactagaagaatactcttattcaattattaataatcctattattaatttattaagttctgatattaaagatataaaagatataatctttctaaataccagtacaaccgacagtaaaaaagtgattactatacaagatcaaaaaacagcactactagcagatataattttcaatacaaatcctataacaattgttggattaaatatagcaagtccagattctataacttatattaagttttacaacattcaaaataatattactataaaggatacagaatttaaacatagtacatcttactacaattaaaataaaatcatgatagaaagtatatcaaaaatcataaaatataactttaaaaatccccaattattaaatgaggcattgacacatcctagtctagtatcaaaagataccttaaaatttaactatgaaagactagaattcctaggggatgcagtattaaacatagtaatatccgaaatgctattcaatattttccctaaagatacagaaggtaacctcgctaaaaagaagacagcattagtttgtggcaataagttagtagaagttgcacagtctataaatctcggacaatttatcatgatgtcagatggtgaaagagcgtgtggtggtataaataatttccgtaatttagaaaatgcattagaagctttaataggtgcaatataccttgacggaggatttacagcagcacaagactttatatacttattttgggaacattctgcaacacatatgaatgtccctccacaagatgcaaaaactatactgcaagaattggtacaaggaaaaaggttaccagctcctgcatatcacaccatagataaatctggaccagatcacaaccctacatttacagtagaagtaagaattccatcatatcaagcaatacaagcaactggtcataataaaaaactcgctgaacaaaaagcagcaagtttaatgttaaatcaaattcataacaaaacaaaatgacaccaagaataaaaaatactatttacatattaataacaataatattatccatggtatgtttagtatatgcttctgtaccattatatagcatattttgtaaagttacaggttacggaggaacagttagaaaaagtaatattttatcaagttccaaaacaggaaatactactattaaagttagattcaatgcagatattaataaacaattgccatggaaattttatccagaattaccatatgtatttgtaaaaccaggcgaacaaaagttaattttttaccgagcagaaaatttatctgataaagacatttcaggaatggctgtatataatgttactcctcataaagcaggaaaatattttaacaaagttgcatgtttttgctttagcaaacaaaccctatttccttatcaaaaaactgttatgcctgtgtcattttttatagaccctgcaatagaaaccgatcctgaaactgctgatgtgaaattaataactctttcatacgtatttttcaaatacaaagaataaatccctatacccatatgtaataaacttctggttgcctgtataaatatgtagataataggcctttatcatcaaatctaaccactatcaaatgacacaaactttacctataactacctttgtgatttatagtaacaagataacacgttcttcagctactaactcttcctcacatctaatgaatctaatatcattaaaaattaataatatacatctcaacttaagtaatacacactactacaaatcaatctattataattctaaataaaatattaactcgctataaattctttttacaataaaaaatgtatcaaattaaagctgacaagtctttagttataaataattttacatgatcacttattataaagcataactaaaattaatgataattaacaacatcattatcattactctaaatttataagcataattaatgatttgataataaaaagacaataaccttaattcatttgatattctcaaattatacatataaactatcaatcaaataatcgtaaggttacagtaatggttaaattttttacttgtttttttacaatcttcttcacaatagctaatcatgctttatcttttaacattaaagttacacatgaaaagctagataatggcatggaagtatatgttatccctaatcatcgcgcacccgcagttatgcatatggtattatataaagttggtgggactgatgatccagtaggttattctggacttgcacatttttttgaacatttaatgttcagtggtacagaaaaattccctaatcttataactactctaagtgatataggcggaaacttcaatgcaagtacatctgaattttgcactatatattatgaactaataccaaaacaacatttatctcttgcaatggatattgaatcagacagaatgcaaaattttaaaattactgataaggcattaataagagagcaaaaggtagtattagaagaaagaaaaatgagagttgaaagtcaggcaaaaaacatactgcaagaagagatggaaaacacattctattataatggatatggtagaccagtagtagggtgggaacatgaaatcagcaattacaatagagaagttgctgaagcattttataaacttcactacagccctaacaacgctatattagttgtaactggagatgtcgatccacaggaaacaatcaaccttgcacaacagtactatgggaagatagaacctaatcacaaaaaatccacacgtgtttttagagcagaaccttcacacaaagcaaacattacattaacattagaagatagttcagtagaaatcccagaattatttttaatgtatcaaataccaagcggtatcgcaaataaaaactatatactcaatatgatggcagcagaaatacttggtaacggtaaattcagtttgctttacaatgatctagtaatgaataactcaatagtcacatcaataggcaccaattataactatttaactgatagtgataactacctctttatagaagccgtacctaaagatgggatctctacagaaactgtagaaaaagaaatccacaaatgtataaatagttatcttgaaaatggcatttcaccagaatatttagaaagtgcaaaacaaaaagtaaaagcacacttaacttattctcttgatggattaagctttatatcatatttctacggcatgaacttaattctaggagtaccattatcagaaattaacaatatttacgatacaatagataaaataaagattgaggatattgattccactatggaaaacatcttcttaaagaacgtaagattagctggacatttattacctaaattgggagaatagttatgaggaatacattattctacataataacattgattttttttgcatataatgcatatgcagatgatattaatatcaacataaaggaagccactattaataataacatacgctacttatatgttgaacatcacgacttaccaacaatttctttaacacttgcattcaaaaaagcaggatatgcatatgatgcttctgacaaacaaggacttgcacatttcacatcacaaatattacaagaaggatcagaaagtaatcatgctctagaatttgcaaaacaattagaaggtaaaggtatagacttaaaatttcatgtagacatagataatttctatatatctataaaaacactatcagaaaactttgaagaagctttaactttattaagtgattgcttattcaatccagtaactgacccagaaatatttcatagggtaatagcagaacaaagtgcacatgtaaaatctttatatggatctcctaaattcatagcagcaactgaaattaatcatgccatatttaaaggacacccatactctaataaaatctatggtacattaaatactattaacaacattacccaagaagatgtatcatcatacataaaaaacagttttgataaggaccaaatcgtcattagtgcagcaggagatatagattcagcaaaactatcgaatttattagataaatatatcctatcaaaattaccgtctggtaataacaaaaatactataccagatgccaccgttaacagagaacagaaactcttatatgtaagaagaaatgtaccacaaagtgtcataatgtttgctacagacacagtatcatacaatgacgaggattattatgcatccaacttattcaacaatatgctaggaggattaagccttaattcaatattgatgatagagttacgagacaaattaggactaacttaccatgctagtagcatgctagataatatgaatcatagtaacgtgttactcggcataataactactgataatactacagtaacaaaatgcatatctgtattaaaagaaattatagaaaatattaaaaataatggaattaatcaggaaacttttttaactgcaaaatctagtattactaattctttcattttatcaatgttaaacaatgataatgttgcaaatacattattaaacctacaattacgcggtctagatccaagttatataaacaaacataattcctactataaaaccctcacaatagaagaagtaaccaaagttgctaggaaaatcttatctaatgatttagtaataattgaagtgggaaaaaacaataatataaacggtaaacagatagaagctaaagaaaacatacttggctaatttattataagtatgctgttagctatataaacacagtaatcacatctactttagattaggtagtaccattcattaatatatagcaaaagcagcatactttcaacttaaagttacaattccataaacacaaaataaaataattgataaatcaataatgcttaaataactacgtacaatttattaaaaataaaaggttagtatctattaaaatcagtatactccttaattaaaaatttttagtattttacacatgtgatttttttcatagtaattatgtttcaacagaataaattactagaggttgtatttgtattcttgacaaaatcatatgaataaattaaaattctcaagtgtttagtcttaacggtattaattatgaaaaacaatccaacaggaccaataacgtctgatttttctgttcaaagattaatgttactggtgtcggtaatatcttttgcggcgttaattatgtctgctctagttgctcttaaaagtaatcaactcagttttagtaatgcatattgtatagctacaatcgcagctgctgcagtgtttatgttctgtgctacagcatcattaatatcttcttgctgcaggagaagccaaacaacaaataagtcacagatcaagaaaaattttgggcgaaaggatagtagtgcatctataatattatatacattaggtgggttatccctcatagcaacttctgtatgtgctggattgatgcttagagatcctacggtgtcattgctcccgtcatttgcacagttcatgaacaaccctctcaaatttccattagctattgcatttgctgtcagtgcagctgtattagcatgtacaattatagcacttgctctcaagcatatcatagcaccagatttacaaaatcatgttacagttataggaacttctgagatggtagatgttgcagcaagagatgagtgtgaaaatttaatgcaaacactcggattagagccatcacacttatcctctttaaatgtgatatcatttgctgatactatgcagcagcaattaccaaaataacagtagatgttaatgtttaaaatcaaccattaagtgtgtgtttcagtagacagtagttcatggtttaatcttgttgttggttttcattctttgttaatagcatctttaagtagttctttcatctatattataaagttatacaagttaaagaatgataaagttagtaagttattttgtaaaattattagctcttaccattattataatacctaagaatataaaagaatctgctaagttgaatgcaggccagtgccatttattaatatagaaatctataaaatcatagacagctccatattttactctgtctactatattccctactgaccccccaataataatagcaagaggtaatctatgtgataaacgtattactaaaaaataaaacaaaacaaacgtaattaagatggaaatactacagaaaataaggttactatacatgaaatcatgtaacataccgaagcttattccagtattccatactgtagaaaatcgcaaaaaactaaatatctctattattcttgtatctcctactaaactcattacgtaccacttactaagttgatctacaagaactaatatacatattatcaatacatattttttcataaactctgctacttggcaatacctttatcaacttaccacattaactgagtataaaaccctatatgcctatccacgtaattcagtaagttgacttataagcatatacttatacatatcttgcatcaacttttttccatttaagcaatatctctattaatctactgtactatagctaaacatttacactacttcgtcatctttgctcccaatatactttaaacttttctttacttgaataatatcctcgttaatctgctgttttaactgctcaatactactaaatttacgttcaggacgtatgaagtccaataactgaatagctacatgctgattatatatatcactatcaaaatcaaaaatatgcatttccaatataggaaaacttaaatcattaaatgtaggtctaaatccaatattaactatcccatttaaccacacattattatcatctatttttatacatgcagaatacaccccaactctaggcactaatatatgtttaatatcaacattaactgtaggaaaaccaataacgcggcccctagccaatccttttatcactttgccattaatttgatacggtctacccaaaatcttacttgctaagtctacttttccttcagacaaatactctctaatcaatgaagaagagcataatttatcatttataaaaataggatctattcttacaatttcataatcataaatatttgcataagaatataacaaatctatgttacctaaacatttatgtccaaaaaaacaactatgtcctactacaatatattttattctacaactatttactaatacatcctttataaaagcatccggagaaagctgtgcaaaactttcattaaaatcaataatatatagataatctataccatagctttgcaacaattctatcttttgctcaagatctaataacaaaaaattttgtttattacgcaaatactcagcaggatgtggagaaaatgtaataaccacagatgttatcttttctctaactgaaatattttttattgcattaattatagactgatgtcctaaatgtattccatcaaaattcccaaaagcaagaacactatttacattacctttttggttaggataaccatatattattttcataataaaattttataaaattcctatatttactttttgctattactatgatatccagaaattcagttaatcataggatacattatagtgataaaagtgaaaatatatactaaagacttctgcccttattgtactaaagcaaaggctttattcaacaaaaaaaacattccttttgaagaaattgacattacaggcaacaattctttgctagaacaaatgatacaacaatcaaacggcatgaagactgtaccccaaatatttattaatgatcaacatataggtggctgtgatgatttatataaactgtatgagtcaggtaaactagaattatagtaacagctgtacatatctgttttttagctaacattcctcctctatacaaatcaacttgaagaaattgacattacaggcaacaattctttgctagaacaaatgatacaacaatcgaacggtatgaagactgtaccccaaaatttattaatgatcaacacataggtggctgtgatgatttatataaattgtacgagtcaggcacactagaattatagtaacagctatacatatctgttttttagctaacatccctctatacaaatcaacattacacctaatttttagattataaagttgcacatgtagtttttcttataagatccaatctgcaacacattcaatgataagcttaggtttatgtgaccataaaatactaacctttcttcaattaacctttaaaacattagccctaattaatttcacacctgtttaactactatgcaacgtaacttgccagataaatcatcgtggtaagtacagaattttaatccataacgatatactaccctatgaatctgatgttgacttcccctatttccaaaatagctatacctaggtttatgtaaccataaaatactaacctttcttcacattaaccttaaaacattagccctaattaatttcacatctgtttaactactatgcaacgtaacttgccagataaatcattgtggtaagtacagaattttaatccataacgatgcactattctatgaatctgatgttgatcttcccctatttccaaaatagctacaccattctgctttaaacatctttttatgattacaaaaatttgtgaataaatttctaatcctattggcccaccatccaaagctaccattggctcatgtaattttacttccggctgtaatgtagtaattttactccttctaatatacggaggattactaactatcaaatcaaaagtatcatagcaagtgttccaagaggataatctcatctttatcctactatataatccatgatttttaaaattctgatatgcaactctataagctttaacacttttttcaatagctataccaacagcatttctataccttaataataaaattgataataaacatccactccctgtaccaaaatctcctataattaacctacgattcttacaaggatacattgcaaacacagaggaaatgatcgtttcactatctggtctaggatctaaaacatcagaattgacaataaaatccgtactccaaaattcccttttacctataatatgtgatataggtatattagtagaacgttgtttcaccattttccaaaatacttccacatcacatttattaataggcatatgtggatcaagtatagtaactaagttttcagtgttaataagatgctttattattatctctacatcacgttttggattgtctatgttataagtagataaaaaatcaacagctctattaaataaagaaattacagtatccataataaattagcatacataaggaggataatgcatattttgtggagataatgtaaatatttctactccattctcagtaacacccaaagaatgttcaaattgcgctgacaaagataaatctcgagttgtaacagtccatccatcttttttactaagtacagtatcacatcttccggcatttatcattggctctattgtaaaaaacatgccttctctaataattacaggatcatccggatcataataatgtactacattcggcgaagcatgaaataccctacctaacccatgcccacaataatcacgaacaatagaataaccatatttcttcatctctttttcaatagccaaaccaatctgattaagcttttgtccaggtatcacttgttcaatcgctacagttaatgctctatatgcagcttcacataaacgttttgctttaatcgatggctccccaacccaatacattctactagtatctccatgccaaccgtctagtataacagtgacatctatattcacaatatcaccttcttttaaaggcaaatcatcaggaataccatgacatacaacaaaatttttcgaggtacaaatagacttagggtatcccctatatccaagcggagcaggaattgcaccagcgttaataataaaatcatgacataaatcgttaagctcattgctagaaactcctggttttacatatggagtaataaaatctaacacctctgctgcaagccttccagcattatgcatatacttaaagtcttctttactatgaatagtgatacttcttcctaaatttcccatattctctataacctttaatcctagacctaaactattgtattaatactctaatgcctaatatccttatactagaaccaatacccatcattttaaacaattttaaacacttgaaataagacaaatatactgtaatgtattagagtaggcaaaaggaattattcagaaatccctatatatttaagtacactaagtagtatttcatcagctactataattcttaaattacattatttttagacataatagaacataaactttccatgagctctatattttacaagactatcttcaagaaagcatttaagtacattccataattaacaacaaccagaattatacctctaaaaacatcctactaggatcttcaatatattgctttattctaactaaaaatgtaacagcaccttgtccatcaacaattctatgatcataagataaagcaatatacatcattggtctaatttctatagtcttatcatcaattgcaacaggacgcttttgtattgaatgcatccctaaaattccagactgaggaggattaattataggagtagacagcaaagacccatacacacctccattggtgatagtaaatgttgcacctgccatatcagcaacttccaactttccttccctagcttttttccctaaagaagctaacgttgattcaagatcagcaaaagacattttatcagcatcacgtattactggaacaaccaatcccttatctgttcctactgcaatacccatgtcataataatgcttataaacaatctcattacctgatatctcagcattgattattggtagttcttttaatgctagcaccactgcctttataaagaacgacataaaaccaagcttaataccatatttcttttcaaaagtttctctatacttagcacgaagatccatcacattcttcatatcaacttcgttaaaagttgttaatatcgcagcagtattttgagattcctttaatcttgcagcaattacctgtctgatcttactcatttttacacgttcttctcttttctcttcagatacaacagataaactactaatactatttgctttagtattatcttcttcagaagcaagtttcatataatttaacacatcagattttgtaatgcgacctccaataccagaaccactcacctgacttttatcaatcacattttcttccataatcttcattgcagatggagcatcctttttctgtataaattgttgcatgtcatcagctactgtaacagtagtactatgtgcagtgttcccctcagatggcttaacagcattcgattttacagtatttattgtacataaaacttgccctctctgtatgatttcctcatcaacaacaaatatttcattaataataccatcttcaggagatacaatttcaagcgaggtcttgtcagtttctatgataaataacatatcaccttgtttcacactatcaccaacattcactgagactctaattggagcctctaatattgactcaccaccaagattttcagcctttacttgtatttcactcataaaatgtaccttaaaaaaactctctacacagacttagttgtacatgccactataccataagcatgactcacaattatgattcaaaccatgacaaaaattcaatatttaaatctcattttatacttaaatagaaatctgacttacaacaataatacattactactaaagtattacaatcatatattctacataatactaatctttactcattgatattactttcaataaaaatttaataatcaacatatattgctatacctttcatttgatttactatcaacatcacatagtacaacaagtacacatttattataacattatcacaactttaacatttaactcaataataaagcgttattgaaattcaataaacaacttttacacaaaaatagtaatcagcataaatcttctcctaacaatttgctgtagtttatcatcttaaatagtcacgagataactgtatataattactagcagattccttaatgtgatttatttcttcttcagaaagcatcctaaaaaattttgctggcctaccagcccacaactctccagacttgattattttacctttagttactaaagagccagatgctagcattgtattctcttccataattactttatccataacaacagaacccataccaacaaatgcataatcatgtatttgacaagcatgtaatatacaactatgcccaactgtcaccattttcccaatttgtgtatcaccataatttctatcaacatgtatcacagtattatcttgaatattagtaccttcacctacactaatcattcctacatctccacgcaacactgagttataccatacacttgcatccttactaatataaacattgcctataacaaaagcagtaggtgcaacaaacacagtactatctatgttaggaaaaaaattcttgtaactgattacattatgcataaaatcactcacttacccacaaacctatatctaatgtttgtatgataacatatcttatacaatgctataaggccagaatttacataacatttacatgcaaccccttaaatctaaacttatacagctatacgactttatataaaaacaacattcctcagcatatcaaatacattgtaacaaaaaatttgcactacacatttgttaaaaaaacataaagtatcttctactgacagttatcacaaaatatattaagcaattatatattgatctaatacaaagattgatatataaaagctcataggttctctgaaatatttttacaatgttacgccatataatccttctactgttatattgttttattagtattcaggtacatataagtaatgctgtggccttacctatacaaacaacagcacctcaagcagcagtattcgatttcttttctaatacaatgttattagaacacaacattgacgaacaaattgcaccctcgtctatgactaacttaatgaccttatatgttacattttactacataaaagctggatttgtaaaaatggaggataaatttaagactagtaaagaggcttggcagaaaggaggtaactccattttcctaagggcgggacagctagtagcagtaagagatttaattaatggtattattacaacatctgcaaatgacgcctgtattactcttgcagaaggcgtagcaggttcacaggagaactttgttgatgaaatgaatcgtatagcacaaaaacttaacctaacaaaatctcatttcagcaatgtaataggtgctcaagataaaaatcaattcatgtcaatacgcgacttaataactcttacagtaagaattttcgaagattttcctgaatattatcatctattctccaaaaaagattttaagtacaataatatataccaagaaaacatcaacttattgtcaccagataatagaatagatgggataattagcatatatacagatgcaggaggatacgggtctatagtagctgctaaacatgaaggcagacgtatcttcatattaatcagcggtcttaaaactgaaaaagaacgcatatctgaaataaagcagttgctagattatgcttttaatgattttagcagccaaaccatctttcacaaaggtagtaaagccaaggaaataatagttaaaaacggtgatgcaaaatatgtagaagctgtgttcaataacgatgtgattattctatatcctaaaggctcatatgatacagtcaaaacctttttttcacacgaaaatgcaatatctgcaccagtaaaaaaaggacaagaagttggtcatcttcacatacaggtaccagaacttacagaacgcgttatacctatgtacgcagcaaatgatataaaccatctcaatttcttccaaagaatattgtacatgttttcccctaaaacagataaagttgctacttcataatgtacagtcatagttctaactcatatcaagtttaaagttatataatatgcataaacaaacgctgtgtttattaatgacttaaatcacatacttttataaaaatttacacatattctttaataaagctattttccttacaaagaacttatatacattgtttaagtagtactttatagaaagcccatagttacataagcttttcatcaagaacttaaaagatcaattataaatcagcaatctctttaacttttacttgttttattaattatgtaaacctaccactatattaaaaacataagatacaatatgaatacatttctacttttctctaatttgtatagtcttgttatgaagtacgctttaatatttatataaaaactagaacaacgtaataaccactataaaaactgcctatagaaattattaaaaatcatatcctaaacttgctatattaattgccacaacgagacaataacattaacagcataaaaaataaagtaacagaactttcatagaactaggaatataataatatttataatatcaacaaataaaaaacttactattttacatatttgtttataatatcaattactatcttttcactgaggacttgtggtaaaactttaatcttaactccatcaacatacaatacataaagcggtacactatttttatccaactgattaatatactctgttaattcataatttttagaagttaaatcacctctcatgtagtaaatttttttcttcataagcaaagcctgtacagtgtccaactgtaaaattttttcattaactttacaagttaaacaccaatctgcacttacagacaacaatactgtctctttcgcttcaagtagttgttctaacttcttttgagaaaattccattactacaacatgttttgcttccttatgtttcattagaaactcttttattggctcaaaacataaaggagaaattgctataaacaataaacacaagcaaattacaaacttacttataggttcccaagattttataaatttcataatccatatccccatgacaaataatatagcacaagataacacagcaaataatatttccggacctttctgtttgattaaaatacagagtaaccacgctgaagaaaaataaagtgggaaagctaaaaatctttgtaaaacttccatccatctacctggcttaggaataattttcaataaacctggaaaaaatgacaataataaataaggcaacgcaattccaaaaccaagaacttgaaaaatcaacactgagtaaaggttagattgatttaaagctacagttacagcagataccataaaaggggctgtacacggggtagcaacaaacgttgataacatacccacaataaaactacctattaatccttctcttttagaattcacattattaaaattaggaacaataaaaggcaaatcataaaatccagaaaaagataatcccatcaaaaacattatatacatcaacaatgcaattaatattggaaattgcatttgatatccccaacttactaaatagccaaaatgacgtaatattaaaagtattgaagacagtagaaacatactcaccataactccaagtgtatataataccccatcagctcttatcaatattttactcttttgagcattcttaaccattgacattatttttaatgataagatagggaatacacatggcatacaatttaaaattatgccgccaagtaaagcacatatcaaaatgtatattgaattaacattaaaaaacatatttaaatattctaaaaaggatataacattaactattaaattaaaaaaatgcacacaagacaactataagtttgtatacctaaaaaactattaacattaataaagacaaatttactattctaaatcacataatttaagaaataaatctacttattgttacaaatcatagctagctttacattctaagttatttatataataaattcaataattaacaaatatgttcaaattaacattaagtgatgtcaaacaatacacacttctaatatacctagacatattataccttatgttcagtctgcaaattttgattttattaatgactcattaatcctgataatatctttcataatgttattatctaagtactgtggaattaattcctctcctgtaatatacttataaagttgataatcactagtattgacaattttctcatattcatcaacgtccttagaagacaatagatgaatgcaatgcaatgcaaaattaccaagtattatatccatttctttgcaccctctatgcaaactcctatataataatctcttacgttttactagtaattcatccataacatttatgttcaacagatttcaaattgtctaattaaaattattacatattatgttgtcaaccatataaatatactatattatccaatttagttttaatgacatctagtgttctacttatggcaagtattattgataacttatatcatgtactcaataatggttcattttatttgctgtcgtttctcattataatgtctattatagttttcgtacatgaatacggtcattatattgttgcaaaattatgcaatgtgaaggttgaagttttttctataggatttggcccagagttatttggaattaacgataagtctggcacaaggtggaagttcagcgtgataccaataggtgggtatgtaaagatgttaggggatgaagacccagcaagtgttgaagcaaatcctaaccgtttgtcagaagaagataagttacttgcattttgtgaaaaacctctataccaaaaatttcttattgtatttgctggaccattcgcaaatttagtgtttgctatagtagtactcatgatgttcttcactactaaaggaatgatgaagcacaactctgtcattggaggcgtagtacaagatagtgcagcacaacatgcaggattagcttcaggggatacaattctaaaaatcaacgactaccaggttaaatggtttgaagaaattaaacagtatatagaaaaatatgcaaaagataatcaagagctaactatagaatatgcacgtgacgggcacattcatgttgtgaaagttaaaccaagcattaaggaagaaaaaggactttttggaagcataaagaaaagtccatttttaggagttacaatgagtaatgtactcagcaattatgaatttcagagattaagcatcactagtgcttttgttcagtccattaattacacttatttactgtcaaagtcaatttttcaagtattgggacaaatgttggtagggaaacgcagtatttctgagttaggtggtcctatacgcattgctcaatattctggagaatcagtaaaacacaacgaagtactattgtgcatggcaatgatttccattaacctaggtgtaatgaatttattaccaattcctatgctagatggtggacatattttccaatattttgtccaagctatattacgacgcaaacaactcaatcctaaatatcagcggtatatatctacaattgggttaatgcttctgctatctttaatgatttttgtcacgtttaacgatataaaaagtatgtttaagtagttttatgagatacattattattattttaatattatttacttcttctcttgcacatgcagaggctttaaatactaaaattaagcaagttcaaatcaatggcaaccataggttagattacaaaactatatatttttactcaaaaattaacttacaagataatgtaacacaagagactatagatcaaatcattaaaaacttacattcaacacaactattttcacatatagaagtatatgttaatcaggataattacttagtaatcaatgtaacagaaaatcctgtcatcaataatatagttttctatggaaacaaagaattcagtaaaaaagatctcgtaaatgatatcttaaaattaaaaaagttagcagtttttacaaaatcaaaattacagcaagatatatcaaatcttttatcactataccaaagcaaaggtaagttaagcgcaaaagttacctatgaagtaaaagaacttgagaataataaaatagatatcattataaaaataaatgaaggaccaacatcaagaataaaaattattaaatttactggaaatcagttcttttcagatgcaatgttaaaaaaagctatacaatcaagtgaatactatccttataaaatattcagtagtaatacaaaatttgcttctgaaagattaatgcttgatcaagcaggattatataacttttacacatctaaaggttttatagactttaagattaaatctgtagtaccagaaattagagaagatcataatattaatcttattttcgctgttgaagaagggataaggtataagtttggtaatagtaacatcatcatagataaacaagttagtaatcaccaacaactaaaagaagaaattcagaatcttatattatcaaaaagtggtgatacatttaaccgagaatccattaataattctatcgaaaaaattacccaatatttaagtaacaatggaaacttcttttcagatataaagcatgaataccgtgtcaaggatgatgtggtcgatatagattacataatatatacaggcaataaagtttacattaataatataagtatcactaacaacaagactactttagatcaagtaatcagacgaaagttgactatttctgaaggcgacatatataatgccagcgtcattaatagatcttataaaaacatattaggattaggtttttttgagtctgtaaatgtagagaatcataaaataaatgacagcttagttgatttaaattttcaagttaaagaaagaggtactggtacattttctgtatcagcaggattttctagtgtcaccggacttgtaggtaaaataaacatacaagagagaaacttatttggaactggaaaaatattgtctttacaagcagaaaaatctacttcttccttatctagcagcattgattttgtagtgccaaatttctcagagactgattcagcagtagggtttggtttattctattcacatcagaacaaaccaaaaggcaaagattttccaaatctcattaacccagccgctattacaggtaatacagatgctgcattcagcagcagcaacgctggtttcatgttacatacatcacatgatataactgatgacctcaatcttgcattgcactatgcttacaaacatgtaaacatatttaatgttaaagatactgcatctgaattaattaaggaacaagctggtaagaatattgattcatccgttggttattctcttcaattccgcaagtttgataatttatctaaaattaaggatggatatcttgttaagctacatcaaagcttttccggattaggtggaacactacattacattaaaaccgaaggttctgtaaattatagcagagagattcttcctaaagttagtagcgatatccttttaaacattaaaacttctatgggatatgtattctcatataaaagtgatgagcaagtaaaaatcaatcaacgtttcataataggaagcaatgaaatcagaggattccatgtatcaggtataggaccaagagataaaaagacattagatgcattaggtggaaagttttactttaatatgattaatcaagttgattttcctatcggtttaccagacgatttgggaataaaaggctctctctttgtcgatgcagcaactttatttggccttgactatataaataaagaatattatgaagacaaatcactaagagtttctgtaggctttggtatttcatggcgttctccatttggaccaatgagattagattttggcttccctatactaaaaaaagactatgatgttacagacatgataagattttcaatgcaatagaaaaaagaggtatttatgcaattaaggttatttttagctatttttatattactattcggtttaagttgccaagcttcggcaaaaaatgatcagaacatccctgtagccttcattgatcgtgatctaattatatctgaagcactcgcagtaaaaagcattagaacacaattagacaacaaaagagaagaactacagaaagatttttcagcaagagaagaagagttgcataaaatcgaagaagatttaagtaagcaaaaagctatcttaagttctgaagcttttgaaaagaaagttgcagattttaaaataaaggtatcaaatctacaacaagatatttctgtaaaaggatcagaattagaaaatatgtatatgaacgctatggagatggtttacaataagattaaaaacatctcagctaaaatagcaaaggaaagaagcattagcttagttttattcttaatgaagaaaaatcaagtattttacgctgctgataatatagatttttctaacgaagtattagaaatgttaaacaaagaattaccaaatatagaaataaagaagtgagatattaattagagatttgtatgcagttcaatattcaagaaatcataaaaatgataccacattcgtatccatttttgttaattgatagagtaactgcatgcacacctaatgaatctgtaacagcaataaaaaatgttacttttaatgaacctttttttattggtcatttccctggtaatccaattatgcctggcgtacttattgtagaagctatggcacaagcatgtataatatgtacaatgagtagcatgcagaattactccgtatatctcatgtcaatagagctagcaaaatttcgcaagcctgttattccaggagacacattaattcttacagtaaacgttgtacataaaagaaaaaatacatgcaagtttgagtgtcatgcacatgtagagggtacattagttgcagaagcacaaattctagcaatgactaaacaaaatgaagcatgatttttttaaatttatacatcaatttttagaaaaatatgaaaataaaaagagcaattatatctgtatataataaaacaaacattatagaacttgcaaaatttttaattgaacaaaaggtagaaattattgcaacaagtagtacttataaagctttattagatgcaggattacaagtaacagaagtatctagttacacaaagttcccagaaataatggatgggagagtaaaaactttacatccaaaaattcatggtggaatattaagtaatcgcaacactcatgctgcagaatgtctaaagctagacatacatgatatagatttagtgattgtgaatttatatcccttctctcaagttgcaaataataaaacttcaaccgaaaatgagataatagaacaaatagatatagggggagttactttattaagagctggagcaaaaaacttccacaatgtaacagtaatatcagatatcaatgactatgatacattaaaggcagaaatgattaataatcaaaattctacaaacttaacatatagaaaacaattagcaaaaaaagcatttgctataacttcatcttatgatagtagcatatataattggttaaataaagatagtaaagatatactacctgaaacgcttgtcatacatggaaataaggtacaggatctcagatgcggggaaaatccacatcaaaaaggtgcgttttacagtactttaggggataaataccctctcaaacaattacatggaaaagaattaagctacaacaatatagtagatatagaatctgctataaacatagtgacagaatttacgcaaccagcagcagtgattataaaacatagtaatccttgtggtgcagcaactgctgatgacattacaactgcatacaacaaagcttttgcttgtgatccaaaaagcagttttggtggtattgttgcattaaatagagaaatcaacgaagatatagcagaggaaatcaataaaattttcatcgaagtaatagttggtccatctattacagacaaagcaatggaaattatacaaaagaagaaaaatgtgcgtattatgctgtccacagagtataatccaccaaaatatataattaaaaatgtcagtaacggatttctactacaagaaagtaatacaaaccaattatcagagaaagacttaatacaagttacaaatttcccagtatcagatgatactatttctaatctattatttgcttggaaaatatgtaaacatgtaaaatccaatgcaattgttattgcaaaagatcaccgtgcaattggagttggggctggtcaaatgagccgtgttgatagtcttgaaattgcaataaaaaaagcccaagattgcgcaggagcagttttagcgtccgacgcattttttccctttacagacagtatattactaagtgcatctgtaaatataagtgcaataattcaacctggaggatcactaagagatcaagaagtcatagaagaagcaaacaataaaaagattgctatgtttttcaccaacattagaaacttttatcactaacagataacttattactactcaacatcaatataacaacctaaaataagcacaatgactataggtgacaatcaagtaaacaaacaaaatgctatacttaacattagaattgtcacatcaactaataatagcttttatattgattcttaggctaacataactatataaacaatatacagttatagcattacaaatttatgataggtaataattaatttgcaagtaacattaatgtaaaactgctattccattaatattagatatccaaacatttaataacttttgaattaatatcaatgcaataactgtataaacagcataccagctatcatgtcataaatttgcagtagacgatatataactattcccactagtagcattaacatttttatcctatattagatagatagtaatgataaagcaagaattccagttattagatgaccaataacgctttcctttctcaaaaatactctaatcaaatgtactattaaaagcaccaataacataaaaaacgcaatacaagcaactattgaataatatttaatattgcatatcacaaagtatctgccacttcgatagagctgaacagaaaaaacaaacaactctctttacggatatatatacttgagagcaatacaaatataaacgtatgcagaatacatagtcaagacagctgctaaatatagtatcgtttcaccaatgtacaatatcacactatcatttaacattaacatagcaatagcagccatttgtataaatgtttttacctttcccaacttaattacaggaagttcaacgcttatagaaatcaaaaattctctcaaaccagaaattaaaatttctctacagattattacaactacagggataatagttaatcccgtaattttacgtatataaactaacataataacggttgcaactacaataagtttatcagcaatcggatcaaacaatttaccaaatttagactgtgcttgccatatacgcgctaaataaccatcaaaaaaatctgtaatacatgcaaaaataaaaataacaaacgcaatataattcgagttactatccccaatataaaagctacatacaatagcaggaattgcaaatactctaaatatagttaacaaattaggcaaagttcttctaaaataatcaaccataatgcataatatcttatattccaccctataataatgataatctcaataacttcaatatttatattaaagttatgtgttattcaaattatgtatatggaaacaactctaacaaacatcacttctacctttaaaatattaattgcatatatacaatttatataaagcaccaattatgaaaactatctactaatttttaatattacatccttagtaaagctatgaaaagattaattaaatgctcttgtgtattttaacagtagatttataatttagcttttaaaaagaccatgcataattatgtcttatataaataactataacatacaactatgtcgtaagtggttattattagctgtatctgctttagcaatatctggacttttatccatatttgtaattttgctcagattgcctatatcaaaatcttttatcacagatgtagataaagtgtttgatatatcgctagtaatacatgttaacttatcagtactagtatgggcatcctcaatcatttctataatatcaagcttaataatttccactaacaagtattcaaaatgtttcaaatatctatgctactccgcatttattggtacatttttaatggtgctatctattttttttcctaatgcagaaccaataaaaaataattacgttcctgtaataaataacttatgttttttactaggactatttatatttactgcaagcatacttttttactcaatattatcaactaaatgtcatcacctaaatattcttcaaggcatttcattgggaatacacggcattccaataatactcatatgcgctgttctatgtttcactatggcttattacacaatacacacaaacaactatttccacataacatctttttatgaaaatatattttggggaggaggacatatactgcaactagctttttgtcaggcattactaatagtatacttaattatattaggaaaaaacactaaactacttaataaaaacgtaatccacgtcatatttataataaacacattatcagttatcgtagcacctatcatatacatatatcatccagccgattctcaatttaccatagatttcttcacatggcatatgcgtattcttggaggagtaatacccgtattcttattcatacttacactattcaatctcaaaatattgctaaaacatagctatcatagtctattatgtacaactttactatttagctatggtggtatactaggaatattaagtattcatggtaatgtaacaatacctgcacattatcatggatctattgttggaatgactatcgcattcatgggattcatttactggctcctaccaaaattaaaccttggcaatacaaatagcttttatactaatcttcaaatttacatatacagtttaggacaatttctacatataaccggattagaatggttaggtggatatggagcattaagaaaagtaacatatttacctgatacagcatcaaaaattgcaaaacactgttttacaatcggtggacttatggcaattattggtggatgtttatttgtaataatagtactactacaaatccgaaaaaaagaagcttaacttaaaactagcgaataaaaactttattgccgtataaaaaattaccactacaactatacattcacatatcaaaaattttattaagacacaacagcaattttctagaaatacaacacttctactaacccaataattgatacttttattagtttaattattttacacagccttaaaaaaattaccattataactgtacattcacacatcaaaaattttatacaagacccaacagcaattttctagaaatacaacacttctattaacccaaataattgatacttttatcaggttaattattttatatagcatttaaaaaattaccattataattgtacattcacacatcaaaaattttatacaagacccaacagcaattttctagaaatacaacacttctattaacccaaataattgatacttttatcaggttaattattttatatagccttaaaaaaactaccattataattgacattcacacatcaaaaattttatacaaaactcaacagcaattttccagaaatataacacctctattaacccaaataattgatacttttatcaggttaattattttatatagcatttaaaaaatcaccattataattgtacattcacacatcaaaaactttatataagacacgacagtaattttctagaaatacaacacttctattaatccaaataattgatacttttatcagtttaattatcttatatagccctatacctataaaaaaccacatgtaaacaactcattgaaaaatacttatttagaatcacagtagcattacaaatttacaaaaagaaacttataaataccaatagtaaaaatattacctatagtaacccattaaacatacatcagagcatagtaacaaaccttgagttcaacattggaacattaagttaagagctacagcgtttttactactataaaatcaacactactactacataaattaccttttacaattaaacatacaacaaactataggaatgcagtatattttgctgacatctataacaaaatcgtattatctttatgctacattaagtttaacattttacttataacgacataagtatataccttactaaccataccaacactgataagtacaaagtaataacatattcaaaattaccttttataattaaatatacaacaaactataggaatacagtatattttgctgataaatccataacagaactgtattatcttttgctacattaagtttaacatcttatttataacgacataagtatatataccctactaaccatatcaacgctgataagtaccaagtaatcacatattcaagatgatcatttctaactttcaatggaacattagctgttataccatcaaacactactgcattaccagcccatattatacaactctctaaaggtatattaatgtgtttcatcatattttctatatcaaaccagaaccacacgttagcattaacgtcattttttacaaaccatccaacctttttgttactatcacaatataaaattccttgaatattctgttgagtagtattgttaatttcaagcttacttgtcttatctaacactgtacccttgttgactaatatatatctaccatcatttaaatgaaaaggttgcaatacataataacctaatgttcctgcaaaaacaaaaaatctataatcattatcaaatgtaccatttacttctatatttttataattttgttttactaaatcatgaactgataatttagtagatggtacctgcatagcatggataatattggttttttcttttagtctaaatatttgccatgtaccaagagaaatcattatagaaaaggggatgacaaaaacaataattagttttaaccacatatcatttattctgtaaatacgctaacatattagactataacgttcatactataacaaaaatacaaattttcattctatgaaattatcagaaaaattttattctactacattgaatgacaaacattatattacaaattacaacagtgctaaaaacaatcaaactatactttctcacaaatctgcacggtagaaaaattatagaaactcataccattaaacttttcctatatttcgttacatcgaataacaaatattataaatatatagtaatatgccaaaaatagcatacaaacattacatcagtttatataacctccttttatatgttcatactatacaagaaaaaaaataatctactttaatatctaaaaaaatatacaatagcaaaactaacattaacaattttatgagatttattacttataataagctaaactacattgtcaacctatacaagtatactatgaagcattgtataaaacacacttttacagttttaataatatatacattacttttgaacactaatatatgttttgcccatacgacagatcaagataatttttttactgtaaaacgcacttcttatactaaagaagattttgtaagcttcatagtaaaatgtcatgctaaaggaatacctttagatttcaagaaggaattcggcaataatttatctggagcagattttagtgatctagaccttcgaggatcagtatttgataacgttaacctactacatgcaaattttactagagctaacttatccaattccacttttatagattccaatatgcaaggagcatccttcattaatgcaaacttaagtaaatccaacataaaaaattcaaacttaaattttgccaatttcacatctgcagatttacaaaaaactacaattacacaatcaaaaatcaacaatacaaactttagttactcagacatgcgcttttctattctaacagaagtcaatggatcccttgcaaacttttctgaaacagaattaaaactagtttcaatattcaactctaatatagaaaaagcaaattttcatgacattgaaggtgaaaatatagtaatccaaaattgtaatttactagattcaaacttttttggagcaaatttaaataattcaaaaattcaattttcaaatctcacaaatactatcctatacgcagtaaatctagattcatcagatataacaggaagtaacctaagtaatagcaacatggaagtatcaaatatttcttttgctaattttcacaatgctaatttaagcaatacaaacatgcatcttgtagatgctcattatacaaatcttaataatacaaatttacataaagttcgtatgagtgatgcaactctaattggagtaaatttaaatcatgctgtgttatctaacgcagatttgagcaacgcagatttaagcaatgtcagcatagaagaatcagatatgcaagaaatacttcttgactctactaatattacaagaacgaatatgaagcatgctattttaaataacgcaactattaataatacagttatttcaaattctgaccttacgatgacattaataaaagattctaaatggaataactctagtatctattcaagcaaattaacctctgcagttatagataacaacattattaaacatggtacatatgataaagtaaatgcaacaaatacattatggtctaattcaacaatagaagatagcaacataattttctgcaattttgaatctgcaatattcaataatgataaaatacataaagtgagcttttttacaaatcacttagaatccgcaaaagtagaagattcaaacatagtcggatctagcatttacaaaaatactctcaccaatttcataattaataattgtgacattaaaaatacaatcattatcaacaataagaattttgtaccaacagaattttctaaacaggcaattacatctattacagctttacaagacgctatcacaaacaataaagtatttgatgtcaatttttctaattttgattttagaaaaataaacttaaacaatgcaaatttttcaaactctatattaaagaatgcaaacttttcaggatcacaattagaaaacgtaaattttactaacacaaatctacaatcttctcaatttgaaaactcacaacttaaaaatgtagatttttctaatgcaaatttagaaaacgcgaacttatcgaacagtaaattaaatgatatcaacacatacaaaacaaatttgcgtcacgtaaaaactgacaatactcagaaataaataaagatttaaacttatacactaaaacaacatcaaataattttatagattgtaataacatatgattcagttacatatcttcaactatcgcaaatctaccatgatgcgcaatatcaagaaacgtaaatcttgatctagtaataaacgcaaattctattgctttactatattgactaatattccatccaatatgctctggtttattgggacaacctatgttaaccagcatgtcttttaataatatatcagataatgttttctctgtaattttttcaacaataaaagaccacttatccttaatcaagctattcaaataatccgccttttgttgattaataaacttttgagcaagtatatcacaatactcttgagtatactgcatatgaaaacactgttttatatcttcatcatttatcaatgtaggataaaaccttggtactgatttcaaaatcctatgttgtaaacatgtcatagttgacatacttacacctattaattcaccatgaaagaaatgcatatcatcttgtaaaagttctatggtactagcaatcatatgttcaccctgactagcagattgacttccgcctacaataaacatacccaatcctgataagagcaaagcttgcattaaaagcataatactatactcatcatgttttattaaccctagataatcgttgattaatgcattttcacttcttttgctaattaaaaacggcaattcagtatattcactacctaacaacaaatgtgataataaccaatctgcctgtactgtagatctacaaataaaatcagcaaaaccacttattattaatctttggggagcatttacaataatatcaacatctatatatatagcttcaggtaaatgagcttgtaatgattttttatgtccattgtttaatactatagatgcattagatgaaacatatccattcatagaaggagctgttggaaatgagatatagcgcttatttgtaatgtaacttacatatttacaaatatcattgattgtaccactaccaaaagatactaaaacatctgaatcccgagatttctctttaattagttccactaatttttgagaagcacaagaccaacgaggaataataaaatgtgcaacactattaaatacaaccttgttcaacagaggagcaagattaacatctgtaactatgaaaccactattaccatactgtttaattatatcgcatatattgtcactgattctcttactaatacgtatactctttattgcattaactactgactccaacttacaaaaactttcatcaactagaatctgctttaaaaatttatcatacataataaagaaacaaccaatgtgttaattattatatatctaataagctcataatacaaaaaaacattctatttattaaaacagtacatcataacttatattgctttcatacaaccaatctacataaacaagcgatcatttcttatataacaggaattggtatatattgttataatcttaatatataatcttcaacaacgacaggttataatactagctacaaaactatctaattcctacaaaatattaagttgttaccacaacaacatataattttaaaacaaggaataacttataatagctaactacaacatctataatttcttttatatcataaaatactatacacacctatcctaaaacttaaaaaagaaatcatataattttttatagtcacataactccaattgactaactgtctgcaattgatatgattaagtataatattctttaataatatcgtgtttgtatggagcataaatgtcagcaaaccccttagatcagtttaaaatttcgactatatttaagttgcctagtattggtgggtacaatatagatttcaccaatgcatcactgtttatggtgttatctacacttataatctcccttttctgctatattggattaaggaaagaaaatatccttccaaatagtatgcaactaatcattgaagcaatctacaattttatcgtttcaacaatagaaagtaatgtaggaagaaaaggattacaatatatccccttggttttcacaatattcacattcattgcaacatgtaacctattaggtgtcctaccactaggatttaccgttactagtcacattgccgtaacattcgcaatatccatggttgtatttatcagcgttacagcaatagggtttaagcatcagggaatacattttctacgtatactattaccaaaaggtaccccaggttggctagctccaatgatggtatttattgagttgtttgcatattgtgcacgtcctgtaagcttatcaatacgtcttgctgctaatatgatagcaggacataccataatcaaagtaatagcaggattcgtaataaaaatgaacatatttctcacccctttgcctatggctttcattatcattttaattgggtttgaaatatttgttgcaatattacaagcatacatatttacagtgctaacttgcgtatacttatcagatgcgatcaacgagcactaaattttatcaattgacttcacatgttgatgtacttataatacgtttaactttttataaaggtaggagtatatggaatctttgaagtttattgctgtagggttaagtgtttttggtatggttgcttctgctctaggagtagcaaatatattttctaccatgcttaacggtttagcacgtaatcctgaaacagaagataaattaaaaaaatacgtttataccggtgctgctctagttgaagctatgggtctattctcttttcttttagcgctattattaatttttgtagcttagcatagatcatggatacaataccacaattagacataacatcttatccttctcagttattttggttctttctatcttttggtattttatattttttgatcagcaagaatattataccaaaacttgaaaatgttttaaaaaaaaggtatactgttacgatagactctgtagattgtgttgaaaacaatttaattctcgcacaagatgagttaaaaaagcagttatctaacctagaagaagcaaaagctgaagcagataggattatcagttctgctcttcaagaagtaaaacgcactaatgcagatttaatagttttattaaatgaagaaatacaagggatgtttagtatagcagatgaatatatgcataacttaaagcgccaaacagaacaagagttaatagatcttacgtgcgaaatagcttcaatgtactacaataaaatgctaggtactgctgaatatgttgataaagataagttacgcgatataactactagattatacaaggagaaaatatgatatccacatattttattaccaacattgcattttgcatcggagccttgtcagctttttggccattatataggaaaatcaatcagcttttatcttcaatgtcaaacaaggtgagaagggaggttatgttaccttatgatatccaaaaacaatctaaagatttattggatagtgcattaattcaaaattatgaaattgaaaaaaccatagccgaagttctaaagacagcaaatgaagaatacaaacttattattgcatccaacaaaaaagatattgagaatattatagaaaaacatcttgatgcagctgtacaaagaatatctgatcaagcatcagcaatggttcaatcactaaagctaaataccgtcgatattgcagccagtgccgttcaagagttaatcaaagaatacaatgagcatcaaaaacaggataatggtggtgttatttctacaatagatcgcgaccttagaaaaaaattacactgaattttcaacttttactgacacgagttttaaaattttttgtagtatgctaccttttttagtcatggtcttctttttaccatatactctattgacaaccaataaaactgtacctatagctgcagaaaaagatgggttgtatttataatcatcagtaataccttttaattctacaggcaaacctattcttacttgccttttaaagacgttgcttgcgacttctttaacattagttaactgactagaaccacctgtaattattatcttattaatcaagtgtttttgcttaactaccctactttttactatatcaaagatttcttctactcttagtctaattattttccccaaatcagaacgtacaactgaaataacctcatcttcaccaacatcagcttctattataccatttttatctggagacactaacatagcatcaccgtataatacctttatacgttcagcatctttaacactaatacataatccatatgcaatatcattagtaatatgaataccacctaaaggtatactatctgtatacattaattttcccttactaaaaataccaatagacgtatatctaccccctatatccacaaccatagatccaagttctttctcatcatcagcaagacacgacaatcctgaagtataaggctctgctacacatccaactacatttaaatcactacaattagtaatacagttttctatattcaacaatgcagactttgaagcagtcaccacatgcatactagcttttaacttacttccatataatccttttaactctgtaatattattcaaatcatcaaggcggtatactactggtatattatgaagtacaacttgttcatctcgacacttatcataagtttgcagcataatatttctgatatcaacatctgaaacttcatgcatcattgcatcaatttcattaacaacactcatagaactaatatcacacccagatacattaacaaaaacctggcttattactggttcctgtgccatttctttcgctgattctatacaagataatattgaacactttgcagattctatatcaataatagctccaccactgatcccttctgcagctttatatcctatcccaacaatctcaaaatcattgttatgagaaattctaactataaaacaaactatttttgtagagccaagatctacaacagcaaaggtaccacttcctggatctgtaatagtagcagaatataacatacaacatatacgataaatgattaaaaatttatagtattactaactctaagtactcaatgttatatccttacaaaagaatatcaagtttttttcaaatttaaatacacaagtaaacctaggtttaatattttcaacaaacataccttctatgtgcaaattgactaaacattttaatcaacataatactttactaatacaaaaactagcaaatatattacacaccttacaatagagctatgctaactccccccttataagccattcaccataaatatacacaaataaaatgttactaaatacttttataacaccaaaaaagattagaatatctttacttaaggtaacaataataataacttacactgttaggttcaccatcaaacaggccattcactattagatacgcacaggcaaaaaattgtataattccaactttctcatcaacatcaaacaagacaaaaataattttactaaaggtaacatataataataactaacacttagactcactatcaaacaggccattcactattagatacgcacaggcaaaaaattgtataattccaactttctcatcaacatcaaacaagacaaaaacacttttactaaaggtaacatatataatactaacacttagacttactatcaaacaggccattcactattagatatgcacaggcaaaaaattgtataattccaactttctcatcaacatcaaacaagacaaaaacacttttactaaaggcaacatataataatactaacacttagacttactattaaacaggccattcactattagatatgcacagacaaaaaattgtataattccaactttctcatcaacatcaaacaagacaaaaacacttttactaaaggtaacatatataatactaacacttagacttactatcaaacaggccattcactattagatatgcacaggcaaaaaatggtataatttccaaccttcccattaacatcaaacaagacaaaaacactttcactaaaggcaacatatgataataattagcacttggacctactatatctcccatcccaggtcctgtattactaaaagcagcagctactgtactaaaagcagtaataaagttaactccactactagatataagtatgcatcctataaacaatacaaaaacatataaaaaaaagaatagccctatgtctcctataaaatttttactaacatatctcctattatatctaatagtacttgtcctagaatgatgcagaagatcactaatataagcattgaaagctttcaataacaacataattcgataaaccttaataccactattagtagaaccactacacccacctattagcattataaaaacaccaaaaacagaaaaaaaatgccaattactatagtcataattgataaaacccgtagaagtacttaaggaaacaactgaaaatgcagaatatcttaacacgttaggcaaagaataacctgccgttatttcatcaaaatagcaatttattgcagatattattataaaaagaaaaagaattatgccaaaaaatattacttgttcatcataaaagcattgctttgtaataacctttacatagagtatcaatggacaagaacttaataacataaatattattgctatcacctcaatatacacattgttaaaatgttgtagagaatcatcataattagaaaaaccaccagtagatacagttgacatcgcatgacatatagcatcaaaccatgacatcccagcaatccaatatagcattgaacacaaaatgattaataaacaatatatagcaaaaatatacattgatgatctaacaatgccatatttaaattttctagattgatcagaagattcagagcgatataactcatgcaaactcacaactttcaagcaaggcaatagaaaaataccacttacaataatacctaatcctcctattgcatttagcaaagacctccaaattaaaatacctggagactgattttgcaaattagttaatattgttgcaccagtagtagttaaaccagatacagattcaaaaaaagcatctatataagcaatcttatcttcaaaaacaaatggtactgctgctattacagaaagcacaatccatacaacagttgttacaataaaaacttctgtcttttttaaattagataatcttccaatagaaatacatatcaaactaaaaaacaaagtaaaaagacatgcacaaaaaaagttttgccagatatatccagtacaataatccactgctactggaataaacataagtagagaaaaaattaaacaaaacactcctataataaaaattatactacgtaagctcttatacatgacatacattttttgatgaatgtacacttgtaatatagaaccattaacacataattaatgacatttggtatcaataatttgtgcagaagaatctaatcttaaatgcatataatattcgaacactataatcctgcccaaacacatttttgtgtacaaggttactaacaaagtaacttatgacattcggtatcaataatttgtacggaagaatctaatcttaaatgcatatagtattcgaacactataatcctgcccaaacacatctttgtgtacaaggttactaacaaagtaacttatgacatttggtatcaataatttgtacggaagaatctaaccttaacatgcaataatattatctaacactatatgcccaaacacatctttgtgtacaaggctattaacaatgtaatttatgacatttggaaccaataatttgtacggaagaatctaatcttaaatgcatatagtattcgaacactatacctgcccaaacacatctttgtgtacaaggccattaataatgtaattaatgacatttgaacacagaaatctgcaatgagaaatcttaaacttaagcacttgatccaattatatctaaatatgtacacacctctttcagcactatatatcaaacgtaattaataacatttacacctaaacagttttcaatacaataaacctatatactatattgcactactaacaacaataacatcggtaatcttttcactatatcaacaagctcaaattcatatgcattatattctcagtcaaccacaagcaatctatcaaaaatctaacatagaatattgtttttaaaaattctaactaacagtgttaatattaagaaatactgctaatacaaaatgagcattacaattctctaatacatactctacatacatgatatacaataaacagatacttctcaaacaaatacagattctccactaaatccatcatacatttcaaaattaataacatttttactactagactgtacaaaaactcataactataataatgtgaccttggaaaggtggctgagtggtctaaagcgcacgcctggaaagtgtgtatgcagtaatcctgtatcgagggttcgaatccctctctttccgccatgtgtttttattattggggattaatgataaatttagggctgttatttcaaaaaaaaattcaaaacttgaatgataattttgcaattgcagtttctggtggaatagatagcatgacactattacatttatcagcacgatactgtaataagaacacccctatagtattaacagtaaaccatggcttgagacctgaagcagcacaagaagcattgtttgtatttcaacattcacagaatttaaacttaaaatgccacatactaaattggcatggtaaattaccagaaagtaatatacaatcttctgctagacgaatacgatacaagttattactacaatggtgtaatgaaaatagaataaaatatttaatggtagcacatcagaaaaatgatcaagcagagactattatgattaggttagaaagaggaagtgggttagacggattagctggaatgcaagaatacacatacttaaatggtatatgtatacttaggccactcctaagtgctagcaggacagaattattacaatatgcaaacaaaaacaatattacttggataaatgatactagtaataacaataaaaagtacaaaagaaccctataccgcaatatgttagaaataacagataatcctgaagtattaattaatagactttacacagcatcagaacatataaaaagatctctaaattgcatcttacattatgtaaggttagctactgaccaatgtttagagtttaccaacctaggacatattaatataaaactagatatatttttaacactaccagaagaaatatcaataaggcttttaacatactctatcatgtctattggtcaacaaaaatataagccaaggtatagcaaacttagtaatatattttctaaaataaaaaataataaacacaagatagctcaaactttatgtggttgtaaaatcacaacaaatcataataacattatctccattactagagaggtatcagcaatacaagaactcactattaactctgctacaaatatagtaatagaatgggacaatagattcaaaataagtattgtcaattctaatgctgacaatgttactgtttctagtttaaataataattatattccagaagagctaaaaaagttacacagagaagcagtacgttgtttacctatactaaaacataaaaataaaattgttgcttaccccctacaaaataatagtaataataactatattgatcaagtaaagtcatctattataataaaagaggtgttggtcaaacaaaattttatcaatttaacttacagtgaatttatcagcaaggagcctctgctatgagaaaaataattgaagggttagcaatttggattatagtagttgttctggttgctgcagcatatgttcaatttaatgataaaatcattaacggtaataccatcaaattgccattctcagagtttttaaacaagattgataataatgaagtcgaaagcattaatataggcgaacataatattactggaaaattgaaagatggttctaaatttcaaacaactgccatagtatacgacagtttaataaaaacattacataatcagcaagtgacttttacttttttacctgaagatacattctttggggtattaagtaacatattggtatcctggttccctatgttattacttgttataatatggtttatattcctcaaacgtatgcaaataggaggtaaccgcactataaactttagcaaatcacgagcgaaattaatgaccgaaaatcgtaataaagtaacttttaacgatgtagcaggtattgatgaagctaaagaagaattaatcgaaatagtagatttcttgaaacacagacaaaggtttcaaaaattaggaggtaaaataccaaaaggatgcttattaataggttcaccaggtacaggaaaaactttattagcacgagcaattgcaggtgaagcaaatgttccgttttttagtatatctgggtcagattttgtagaaatgtttgtaggtgtgggtgcaagccgtgtgcgcgacatgtttgaacaagggaaaaaaaatgccccatgtatcatattcattgatgagatagatgctgtaggaagacacagaggaattggcttaggtggaggaaatgatgaacgcgaacaaacattaaaccaattacttgttgaaatggatggatttgaatctaatgagggagtaatcatcatcgctgcaactaaccgtccagatgtattagattcagcacttcttagaccaggaagatttgatagacaagttactattagcatacctgatattaacgggcgagaaaaaataattaatgtacatatcaaaaaagtacctacagcaccagatgtcaatattagaaccattgcacgtggtactccaggattctctggagcagatttggcaaatctagtaaatgaagcagcactaatagcagcaagactcaacaaaaaaattgtcacaatgagtgattttgagtatgcaagagacaaagttatgatgggagctgaaagaaaatcactaatgatgacagaagaagaaagaaggctaacagcttatcatgaagcaggacatgctattatcgcatttttcacagaagcatccgatcctatacataaggcaacaatcattccaagaggaagaagtttagggttggtaatgagactaccagaatcagatcgtgtctctcatacaagggaaaaaatgattgcagatttgacagtagcaatgggtggaagagctgctgaggaattgattttcggataccacaaagtaacaagtggagcatcatcagacataaaacaagcaacagaccttgcaaaagccatggttatgaagtggggaatgagcgacaaagtaggtccgttatatcacaatgacgataaaaatgacactatttctaataacttagcaaatttgatagatgaagaggtcaagcttatagtaacatctgcacttgaaagagcaaaaagcctattaaatgagcatttagaatcattacatatagttgctaaaaatttattggaatttgagactctaactggagaagatatcaaaaatataataaatggtaaagaactgaccaaagatgatattgaggaatctcaggttttaaaaagatcattcgcttcaaaacagtaatctaccccttattgtaagacatctgtttatcattggataaagcttaaagccaccgtgttgctgataggttagcatctactaaaataccaaaagtctcaactggaaaagatataaataccacttatcaaatactgataaatctttttcagacttcaaaaactacctaaaaagaacaagcaatttatcctatatgccaaagctatataatacatattattattataaaacgctaacaaataaatttataggtacactacatcaaatttatacatcatcaaaatacaaatttgcataccaaaactcatatgatttaaaaaactatcagataaataaactttaaaatacacaaattttaacacatcatcgctgtatatatactacttacaactttttttatttaagcctaacataacaaaaaactttcaactacatttcaaaaacaccctatacttacaatatcacagaactttaaattgatgtctcttgtaaaaaacttcaaacatacaccaacataaatctagaacacaattccaataactctttcagtccatcaaattagttatgattaggatttaatgtacacaaagatctgaatattacaatcacacttcaaacttacaagaatataccaaaaccttaattctgattggtttaatagcaaaactcataacaaattgttactgcctacaatattaaagtttatatatctattacaacatgtttactctgtctctagcaactcagttttttttacctctatagttacatctacaacataagtagaaggataaagaggactactattttcctttatactcaaatacaaactttgcaaaaatgaagatttttggctatcggaaagaaatggagtaaataattttgttttcattatacagttaaaaatttatattaattctagtatatttacagactatattacctttttcataaaaaggcaacatcgtcttataggcgaatttaaaactgcagtaggacaaacaaattaacatttcacaaagcattaaattatttattacatacaggagttttggatattacagttataatcaacaaaaattcaatcctttcctaaattttcaggatagatgcaataattttacattgacaatttagctttcatcttagctaattttataaaataaaaacccataatcaccatgaaaacagatagcaattgtcccatagttaactgattaaacaaaatgtaaccaacctgagcatcaggttctctaataaactcaataaaaaaccgcactactccataccatatacaataaacagcactcagcattccttgagatgctctaacatttgtaaagaaaaaaagagaattcattattacaaataatagaaacccttcaaaaaaagcttcatataattggctgggatgtctatagaaagaatcaccactattaggaaaaaccataccaaattttatatctgtgaccttaccatataactcaccattaataaaatttgcaatgcgtccaaaaaatattccaacaggtacagcacatgcacctaaatcaagagcagaaagaatacttattttattttttctacaaaaaatatacatgccactaattatccctattaaaccaccatgaaatgacataccaccattccacaacttaaacatttcaataggaaaatgtatataaaaatctaagttataaaacaatatatatcctatcctaccaccaagaattatagaaataacccaccatgacattattgattcataactttctttgctaaaaactctatacttatctatttttcttatataccaataagcaaacactatacccaatacataggataacgaataccactttatttctagtaatcccaatctaaaagctactggatctataatcataaaagtatataaaatatatgttctgaatagtatgaaacaattgcaacattttcgcaactcttaccacatcatatacatacaaacacagaatcctactaactttctctacttaacattagatactatataacacattgcactcaaaacattttgataatatataaatacaatagtgcattatactttatatagcatgactattatgatagtaatatctttagtagaatatttatcttataagttacacaaatttatacggttttttcataagtaatatgctatgtagtaatgataagataaatttatttagtatacttaaacaatgttataagtatacaggtttaactcacgttgtgcttgttataaaatatacttcatgttcttatatatgccgtataagaacttgcatattaaccatgcacatttcactacacctgttaaaaaaacttataatacaagctattctactaagattattatatatttcacacattatgatgtaattttaatacaatctataaaaatattcaacaataacttgctacattatttatttattaataaatgttgagcataatattaatattcaactctaaagagaaaaagtcgtgatatcaaatattattattagtgataacagtagtataacaatatttttcacgggaaaagatgaaatagaaaaattcactaaaatattcactgtattagataaaaacaaagctgctaaagccctgttcaatcatgaagttaatatagaatatcaagataaccgtgcaatattgacatcttctacaaactttgaattcagtgatcttaacaagataataacacacatgttacaacatgattttataattaacacaaataccatagagcaatctctagaacaaggatgtaataccttaaaaactgataacttagttatttgtaggtttaatgataagccactatacagtattaatatcagtattaggaacaacacaattatattacatcctatatccacaaaatatttagacctatcttcagagtacaatcaaaaactaatgagcttactcaaaacacatactagcactagcgatattaccatagataataaacaaaatagtattttactatcgatcaacactgcaatatatgacataatacagtcacttgtaagcacattaataaaagcacaaattaccgaagaaagtgataaagaaaaaattttacaacagttgactaaacttgcttttcatgattttacatctaatgagttacaaattgtaaaaacatagctctatatcctactgatcatcccttaagcaaatataaaaacatagccaaaaatgtagaaaatattttttcacatttagcaagtaaccaactgctagattcatactctgttaaactattacaagatgctataaataatacaggagaattctccacagccccacatattattatgcgtagctttagcaaattgaataaaaacttttatgatcaagtacaaagcataataaatcaggcacaataatttaagattactacacacatattgccttacagcttgaataaacaaatttggagtaaaggaccaaattttaaacgctatctccgactataacaaagaactcccctgctacaaaatcaaacaatatgacaaaccttaatagttacagttaataaaaatccaaactttgaaggctattgcttgataaagaactcatcgaaaaatcaagaataatatacataaatcttgataactatcatttcacaaaaataactctttgtgtaaatactatgttttacctcgctcaacacctacaccttcaacaacactgtcatcaacttgtacacttgttctagtactaacattttctaaatcacgtgcttctatatcaacactaggtgatccttcattttcttgcctacaatcattttgaggttcatgttgtggcaatacaccaaataaccccgctttatatgcattaaaaagtgcaaacttaaatttatcaagaaactgataactatttccttcaacattaacatgtttaacatcatcaagcgcagaaatttgcttcttcatagacacacaagccgtagtactaaggccacctaactttgctactaactctctatcttgcttatagtattgattacataataaagtaacacataacacaacagctgtcatcataaccatcacgctagatactatagggacatacccatccataatacatcctgtatacaagaaaaatgcacttatcgttaacataaacactgcaaacatcatacaaacagcagcacaaatttttgaggttgtagtttttaaagaaagtaagtatattccttctgcaaatatcacaagatatgatagcatcgaacaatacaaagccgctttatcacatttcagaagatgacatgccaatgctaccatgtgtgcaagacatacaaacgctaataccaaaaacgttgtaattcttgtccataattgtctttttgtaagttcttcattactagctacaaggagtagattatgtttttcacttactgcttttcccaaatcagtaggttgatcaccctctccttcatgttctttaacaaatcccctttttttcgcttcttctatgatgtatgattgcactgctttttctcttgctttatcagttccattaaccataacatcataaacaccctctgatgcatttgcatataaccgacattgccatggcaataaattcatattatatgcttgttctctaagctccaaattcccaatataagataataaaagaagtggaggaagcaaaggaagagcaagagacaatacactcgcaacacatcttatcactttctcttgagttgtaagtaaagaccatcgttcagcatacaacactgcatcatatagtttctgttttaatggtttactgtttggatcatatgtagctatatgaatttcgcgtggaggtttaccaccagcactactgtcagcaaaattctttttgtttctttttacaatactacatatatcacgtgatgtatacccatcacgagaagaaacaatcaatacagtcctatgactatactgtttggttagactataaacaggagtgtcttcactgtctaatattggataatcagcacatactactggtacaaatcctaatcctctgacaaaatccgcaagttcttgtacatcaccttctttcttagaacgatgcacaaatactctgcttaaaaagtttccatctatatcatcaccctgaggtccaaccataacagatgctggtgtaacattacgcactaattgtcctacacgaacaataccaacacctggaatatgaaaaacaacacgttttagctctttaaaaagtttatcatacgcatggtaatcttgactattttgcataagtattgaaaaaaaactatctactataaggatacgatataattcctgcaaatacattaattatttaagcatagaagtaaggattttatttctggtaaagatcattacgtttttgtcaagcacattgaatacttactgtcagttttatacaaaaccaactaaccacttgtttgcacgatgacaaactagatattctaaaagctcaacaataaatactgcatatactcttcattacagttttaattaacattttttttaattacaactctaaatttgtgatattacaaatgtaggatgttcttatagtgttatgtttttgaaatgcagttgaaagttttttagttatgttaaacttaaataaaaagttgtaagtagtatatacagtaatggtacttaaagtattacaaacacactcacatcaatctcgagaggcaaaagcaaaaaccttactacagtagggacaactaacttcttgtccaattttaacagtcaaatatattttcggatgttcaatatactcagaagcattcccttccccactgcaacaaactattttcactttatctttctcatcactaccagacataaatcaacttttcaaaatttcacaaatcatatacttaatgtcttcaaattaaataatctaatatataaatctattagcatctttgttaaagttattgcagaaaacatggaacataaaatacctattgataatgtaatagcaaatccactaatagggccactacctattacaaacataattgcagcaacaattaatgtggtaacattagaatcaaatatcgttgacatagcatttttaaagccagattctacagcccattttaacttttttgtagactttaactcttctttaatacgctcaaaaatcaacacattagcatccacagacattccaactgtcaaagtaattcctgcaagtccaggtaatgtaagcgtagcttgaagcaatgtaagtatggtaataataaaaacaatattaaaaactaatccaattacagctaaaacaccaaatatacgataagaaaatataataaaaatagaaactgctacaattgatattatcattgctaatctaccttgcttaatgtattcagcacctagactagaacctattgttttttcttctattactttcaaaggtactggcaaagctccagattttaacaatatagataattcttttgcagtttcaaccgtaaaattaccactaatttcaccacttccagttaaaataggttcacgtattataggagcagtaagtactactccatccagcactatagcaaatggtttattaaagttttcttttgtaattttagcaaactttttagctgctgcattattcagcttaaaatgtacaactacgttaccaagattatttataccagatgacacatctattaaagaatcaccactaatttcaactttttttaatataggatatgtatttccacgatgatccttaagcaaaacagtagtaagaggattaatagatgataactgactaacattttctagcaagtgaaatgtcagctttgctgtcttgcccaataacgtcttgatttgactagtatcatgtaccccaggaatttgcagagagattctatctttaccatgactatttataataatctcttttgtaccagatttatctaacctacgtcttatgttactaatagaatcagatataacattcctcaacaaacttgccttataactgtcataaaaagacatgacaatctgaccttcctgttcaaatactctaacgtttttattatcaaacaactttattttattaaaatcctgactactttttagtaccaacaccagtttatcctgctctacatctagtttactatactctatttttttgctggataaaaattcactcatttcatcatacaagctatacattctttcttttaaatattctttaaaatccgcttctaacaacaagtaaacaccaccttgcagatctaatcctagattaactttttgttttgacagcaaaaatttactattaataaaatttggtagtattaaatatatagcaagaacacataacaaggtcacaactataggcttaatttgtaacttagaaaacatatcatctaccaaatatatctggctattatattatattattgcaacaaacaaaatattttatatttctaagacaaatcactaatctaatacagcacaacataatatgaatgcaaccaaattgaaaaacatcgtacttaaacaaatgtataatgttttcatgtatacttaacactccttattcaaaaacttattaatctatcaaacacattgcattttaatcataacaataggataaaaccctctatattaaaaataatacatattaaatgctatttaactcttacatcctatttcatttatagatatacacatcaaataagtaattaatctaaaaacacaatttgctctcataataattataatcataaggatcgactttcatattgtcactacatgctatacatgcactatttttttgaaatgtatatttagtaaactcattagatcgcaagtctattctctgcaaattccctactaaattatctggaatttttaataaatattttatagtttctgcaactgcaatacttcctactactcccaccgttgctccaagtattccagcattagaacaatttaagtgcagactcatatattgacattcaaaaaaacatcttagacaaggtttaccataaggaaatactgttaacacttgtccagtaaatccaatcgctgcactatgtactaaaggtttacctaacaaaacagctgcatcattaagaaataactttgtagccagacgatctgtacaatcgacaacaacatccacattcttaaacacttcctcgaaatttttaggcgtaacaaaattatttaacacttgaacattaacatcagagttaagtgattttacaaactcctgtgcttttatcactttactttgattgatatcactctccttataaatcacctgtctattaaggttggacatttgtattttatcatcatcacacaatgtaatatggccaataccactagcagcaagtagaggaataactgtacttcctaagccaccacaacctattatcaaaacattactttcacttaatttactttgacctactttgcctatctctgaaataagaacttgtttcttataacggtcaaacactaattttcctgtaaatacctactacctggaactgatacaggtatctttcgcaaatattctggaacatcttcatctacataacttttaatatttaattcaactaaactaattataggaaaaggtagtttaatatccctactacgtttaactaaagctgcacctgcaacaacagtaccaccattcttctttacacaacttactacttccatagaagtttttccagttgtaatcacatcttctacaattaaaactttacttcccttttttatttcaaacccccgacgcagtgtaaacagtccattaacacgttcacagaacacattattaatacccaactgcctagcaatttcatagccaactgtaatagctccaactgctggagaaactataagatctatatttggtaaaactttaccaatctttgtagcaagtaaagcacaaaacttcaccgcaataactgggttttcaaataacctagcacactgaatataagtatcactatgtaatcccgaagataatacaaagtgaccacttattattaccccaattttagtaaattcaccatatatagaatcactatttaataaatccgcttccataacaaaacaccttaaaaaactgtttcttctacttcatgaagattatcattaacctctgcattgaaacaactaacttcattatcacttgcaagtatacttcttatcttctgttctatttcatgtgcagtatcacaattagctttaagataagattttgcattttctttaccttgaccaagacgcacactattatacgagtagtatgacccagctttttcaataatattaagttttacacccatatctataatctctcctacctttgagataccttcattatacatgatatcaaaatctacttgtttaaaaggaggagccaccttgtttttaacaactttcaccttagtttgattaccaataattacgtccttatccttaattgcacttaccttacgtatatctaatcttacagaactataaaactttaaagcattgccaccagtagtagtttcaggatttccataaactacccctattttcatacgtatctgattaataaaaataagaacacaattagcttttgatacaatagaagttaacttcctcaatgcatgacttaacaacctagcttgtaaccccatatgttgatcacccatatcaccttctatctctgctctaggagttaatgcagccacagaatctactactattacatcaatagcaccagaacaaaccagatactcaactatatgtaatgcttgttcacctgtatcgggttgagaaacgatcaaatcaccagtatttacccctaatttgcgagcatacatgatatccaaagcatgttcagcatcaataaatgcacaattcccaccctttttttgtgactcagcaattacatgcaaagcaagtgttgttttaccagaactttcaggcccaaaaatttcaacaattctacctttaggaaacccaccaatgcctaaagctgtatcaagcgcaattgatccagtagaaatactatctattttttcaatagcaccttgttttaatttcattattgcaccacgaccaaaagccttttcaatttgactaattgcgctatccaatgctttttgtctttcctggtttaaatttttgctatcagacatatgataaatactttataaattaaaaaagctaatcactcttaatattaattgtcaagttataaatcattgcaccatttatttcaaacaaaccaaatttaaacattcacaaaaggttcttctatcttaaaaatcatggaataattatcaatgacacaaacttaattagtataagctcaaatcataactatcaacacctataaaactagcaactattttcacctaaaatgttaaaaataagattttatcctcattcatttttttcatagcgaagtataacgttacaattcatttcaaaattgcaatacttaagtatcataccaatataaacattacacaaagttctataccttgtaatcaaaggttaagacttatcataattatctgcacttataaaatttactatattatctgatgtccctttccataaatcaaaactacctgtaacatagcgttgaatatatactgttttacctgtatattcgtaaataaactttactatatcatcaacattaacaacgttgttatccttaagagtaaggacaacctttacagacataccagacaacactttcagtgctgttaatgtatgacttatgctgcctagataagagcctataaccaaaatcacattaatatttaaatcccgtattatatctaaacaagttttatcatctgtaataggagacataactccacccactccttctattaacaaataatcatgagcctgactaatacattgggaacaaaatgtcacaattttattatagtccaatttagtattttctaacttagcggctatattaggagcatgtggataatacaacctccaaggtgaaactttcgttatattactatcatgacaatccatacttaaactacacagtattttacctgtatcattatctaaaatattcgcatcactccacccactaataacaggttttattgcatgtactaccttataacttttacttaaatgccaacacagggctgtcataataaaagtttttcctatatcagtaccgcaagatgtaataaaataagctgacatttacacaacaaccaatataatttaacaaacgtatcctaactgatacaaacccagttcacaatattttagaaacaagggcaattcaatatgacagatgcaactaataaaggatttttcagcaatatcaagaaaggtttatttaaaacctcatcaaagttaagtgacggtataaagaaaattttttctagtggaaaaaaagttgaccaagaaactttagaagaattgaaagaattactcatcacagcagatgtaggctatgacaatgcttcactacttacacaaaaacttgcatccacaaagtttaatgaaatggatgataatacagtaaagcaaaaactcgctgaatctatagaaaacatcctattacaagttgaaaagcctctctctataaacaataagccacatgtaattatggtatgtggtacaaatggaaatggcaagaccacaactataggtaaattagcacataggtttaaaaacacagggaaaaaagtactagttgcagcatgtgacacatttcgtgcagcagctactgaacaactaatagtatggtcacaaaaagtaaatttcccagtagtaacaggcaatcagggagcagatgcagcaagtatagcatatcaagcaatgcaacaagccttaaatgaacaaaccgatgtcttgctaattgatacagctggaagattacataatcataaaaacttgatggaagaactagcaaaaattagaagaattataaacaaacatgacaacaatgcacctcatgatgtcatactaatattagacgcaacaactggacaaaacgctgtcaatcaagttgatgcttttttacaattcgtcaatattagtggattaattataactaagttagacggcacagcaaaaggaggagtagttataagaatagcacaaaaatataaattgaacattcatgcaataggtattggtgaatctgtagaacaacttcaagacttttctgccaaagaatttgctgcaggattactcgacataaacaccatataattgtagtcacttaataaactgtctaatattcagccatatcagcagagtagtcataagaatagcacaaatataaattgaactcatgtataggtatattgatgaatctgtagaacaactttaagacttttctgccaaagaatttgctgtaggattactcgacataaacaccatataattgtagtcacttaataaactgtctaatattcagccatatcagcagagtagccataagaatagcacaaatataaattgaactcatacaataggtattggtgaatctgtagaacaactttaagacttttctgctaaagaattcgctgtaggattactattcgacacaaacatcatataattcaaatagttactcaataaactgtgtaatactcattatacacatgaaaaccagattaacgtttacaagtccactgcatttaccctttataagccacgttaaataatatgctcagatgtaattatcctgtattcgaacactttcataactattacatataccataacacaataactactacaaaaattattaatcaccttccagactatcctcgcaatcaatgttggaacagtaaatatgttcaataacaaataccctttatctgaaattctataacaactacaacattacactattgctaattatttcttactaaaaagaaattcatattacattaacaagctactaacttattttttaatctaggttaaaagcaacacgtataacaacaatcattacatagtaaaaaagccaggttgatcattatataagtataatttttccatttttactacatctattttcttttgctctatgtcaaaaagcaactgattaatatgctcattcatgattttatcatctttacttttcatgtaaaacctacaacatacctgatccatataagaaagatttacactcacagattcatcaggccaaatttctaatcctttattatgaattagcacaagctccagtttatcatgtgtaatattttgaagattattaattaactgcttaaaatctagtcctacaccatcacaaccaatagtaatatccactcctacaagaactctagtaacataagatggttcatatgtataagatacacccgtcctatctacattatcctgaaacattgattttggtaattgagatggagattgtccaaaattttcaacaacagccttagcaaaatccattgtagaaacttttttcttgctaacctgactttggtaaatatctgctgtatgaataccatcttctaaagttttaagaaatgcattataaattagctgtgccttgtcaaactgttttaaatacatcaacatttgtatagctgcattaagtaatccagaaggatttgctatgttctttccagctatatctggagctgaaccatgaacagcttcaaacattgcataattattccctatattagcactacctgcaaggcctatagaccctgataattcagcaactatatcagacactatatcaccataaagattagtagtaactataacatcaaaattttcagggttagaagccacttttgccattccaatatcaacaatataatgatctgattcaatgtcaggataattctctgcaatctttgaaaaagacttatgaaaaattccatctgtcattttcataatattatcttttatcaagcaagtaactctcttcctattatgaaccttagcatagtgaaatgcataatcacatattctttctgaacctgatctcgtaataacttttgagcattgatacgtatcattagtcagcctatgttctataccagtatatgtatcttcctcattttctcgaactatcactacattgagattaggataccttgtctttatcacaggatgataagaaatacatggcctaatatttgcatacaaccctaatctctttctcaacgtaacattaagacttttatgcccacgaccttgtggagtcatggtaggagacttaagcagtactttcgttctataaatagaatcccaagatgaaggcgcaataccagaagaccattcttttttatataaattgtgtcccacctctatagtttctacaactagacctgattctgcttcactcaagatcaatagtacagcttccataatttctgggccaataccatctccataagcaactgttattggaattgacattatacttcttccattttcaacaataatatagtatatcttccagactaaaaaatttgattatatagacaatataatattaaaaacaacaaaaatatatcaaacatgtctatatctaataagacgatataagacgttaaacaatttgctagtaccgtcatcaaccaaaatttatgctcttatcaaaacaataagtcacataaatatgatcatcataatctacattcattaatttatatcagttaacaaagcaagcatctgttctctttactattttatattactaataatcttctttacaaaatcttaaaattataaacacaaacacactaaaataatgttatagtaagtataaaatagcagtgttataatacatatttttagttaacacagtatgctacattgcaatttggaaaatttagaatacattggggtaacaggtgcactatggaagccatataatgtaaacttccgtgatgttttaacaataacacaaaaacttggtatatctgaaattgttgcaagagtattatcaacaagaaaagtaaatatagaagagatcaatgactttctatatcctacactaaggtcatctttacctgatcctttccatcttttagatatggacaaagcaatacagagaatttgtcacgcaatatataataaagaaagaattgttatttttggagattatgatgttgatggagcaacatcatctgcattaataaagcaatacttaacacaaataggtgtacctacaacaatatatattccagatcgtatatgtgaaggatacggaccaaacactcaagccttacttaaattacaagaaattgggcacagtttatgcataactgttgattgtgggactatagcacatgaaccaatatccgtagcaaaatctgtaaatcttgatgtgatagttatagaccatcatatgggcttgaacactttaccagatgcaattgcagttattaatcccaatcgcctagatgaaaattctccatatacatatttagcaggagttggtgtatcatttttaatgcttgtagcactaaataaaactttaaaagaaaaaggattttttacaaataacaacgaaccaaatttaataaactatctagatttagtagcattgggaactgtatgtgatgtcatgcctattataggattaaatagagctttcgtaaaacaaggcttaaaaattatggcaacaagacaaaatataggccttaaagtcttgtctgatgttattggtttagaagataaaccaaatacttaccaactaggatttaatataggtccacatattaatgctggaggaagagttggaaacgcaagtttaggagcaaggctattatcaagtaatagtgaagaagaagctctagaaatttcagaaaaattacaaaactttaatctagaaagaaaagagttagaacatagaagtttcaatgaagcagtagaacaagcagaagctctaatatcaacaaatacaaatttaattatagttgcaggaaactggcacccaggaataataggtatagtcgcaggaagacttaaagataaattttttctaccaagcatagtaatttcactggataagggcattggcaaagcgagcgctagatcaataccagatgtagacttgggtgcagccattttatcagcaaaattagaagggatcatcactgaaggaggaggacatgccatggctgctggattctcaatacaggaagataaaattaaaacattaaatgaattcctttcacaaagatttcacaatattaataaacaaaaagtatttaaagtagacggcattattactgcagcagcagttaatctaaccttatggaaagaattacagtttttagaaccctttggcataggcaatcctgaaccaaggtttatcctgacaaatatcaaaataaaaaatccggagattataggagatagtcatataagatgtttaattcatgacaacaaaacttttataaaaggaatttgtttcagatgtacagacacagaattgggcttagctctattagaacgtactgcaatcatgttactaggaaaaatcagcgttaactattggaaaggcaatgagaacatacagtttataatagaagatgcgattacaaaaagtcacaatgatcacaaattataaagattataggaatactcaacacaaatgttgttattggtagataaattcaataatacataacctttacaatctacaaggacattaaatagcaaaaatattacaacagtttttccttaataaatgatctttaaattagtatatatttcatactattggctgtaaatatatactctcacatctacatatttctatagatataaagctaaataatattaatttcatgtaacaataaccattcacattatattatacaaacaatcaaaaaattaatagaaaaacaatgatcttttaattagtatatatttcataccattagctgtaaatatatacgctcacatctatatattcctacagatataatagctaaatgatatcaatttcatgtaacaataaccattcacgttatgtacacaaataattaaaaattaataggatttaaaaaaacaatgcaatactatcagtatttgtttaacattttactgtttcaacaatctaacgttacaaatgtacgatgactttataaataatgagaatattctgttaatcataaatgcaataaaaaaatttcaaggagatattaggttagtaggtggatgtgtaagagatagtcttctaaaaagacagaccatagatattgattttgcaactactttattacccaaccaaacaataaatgctcttactgcagctcatattaaagctattccaacaggtataaaacatggtacaataacagccttagttaataatacagcatatgaaattacaacactaagatctgatattagctgtgatggaagacatgctgaagtaaaatttacaaacaattggcagcaagacgcttcaagaagagatttcaccttcaatgctctatattgtgatgaaaaaggaatagtatatgattatttttctggtatccaagatctagaaaaaaaacatctaaattttattggagatccagaaattagaatacaagaagactacctacgcatacttcgagcatttagattttatgcttctatatgtagtcaaaacaaattgagtgatgaaatagtgcactcttgcacaaaatattcatcttatatcaataacctatccagagaacgcattcgcgatgagttctttaaacttttattatgtcctaacttatcaaacacattaaagattatgcaaaaatgccacgtgctagataaaatcattccctttgaagtcataccagacataatgtcatctgagaccttatcaaacacagatccactaacaaaattagcagctcttttaagaacaaacaataacaaccactctctagataaaattaaagcttctttatgcttatcaaactacagtcaaaaaacacttgtgtcactattaaacaataatttagaacttccactttcaactaccgcacaacacaaacacattaacaagcttggaaaagaaatatactgcaatctactgagaataatacatgcagaattaaatttaaattatcatgacctaatgcaatatatagagtacgcagatcaattaattattcctgaatttcctatctctggaaaagatttacttaatataggataccaaccaggaaaaaatcttggtatcactttagaaaaaatcaaagatctatgggaaaatagttcatatcaactaacaaaaacccaattattagattacgcgagaggaaaattattaaaaagtaagaattaaatctcgtactatcttcaaaaaattacataagataaaaacattttattgcaaactgtattttacaagaaattacatagctatttccaaacacactaaaatatattcttttcctatcgaagaattcataattcttcaaaggaacatttaaaacaaatataaactcaaacttattgcacagaaatcaactattacacttaaaagtataaacaatataatattctatttatacaaaagccatttcattaagatatcatatctaaattgatactttttacataatcacccaactatcacctgtatatacaacaaactaaaattgacagataaacaacagaagtactttaagtaataaatacttatattacaacaaaccaaggtacctgaacttaaaataacaacatgttattataaattcaggctttaacatgaatatatttcaatacaggtaattacccatttaacgctaggagctcatagtcactaaagaaaaatcttatttctctcatggcattatctaaactatccgaaccatggacacaatttgcatctatattctcagcaaaatctgctctaatcgttccaggacttgcttttttaggatctgtagcacccataatttctctatataagcttatagcattttctccttgcaacacttgcactattattggaccagataccataaaatcaattagaggtacaaaaaaatgttgagatttatgtatcgcataaaattcttcagcttgacaacgtgttagtaaacacatcttttgtataattattttaagtcctgaattttctatataagaattcacctgcccagtaatattacgctttatcacatctggttttaatatagacaaagttttctctaacaaaatacatccccccttacccggacaaactgactttcatgtttaatataaattattgatccaatcaagctaaaaagtaaataaattttatcttatatttcataaagcataatatgttatttctgtatattatataattagtatactattccagcaaactagatagaatatatccattaaataactattgcattcactttatgcatgatttatcttacataggttgctttgttataggaaaataatatgtctacacatgcgaaaaacaaaataaataaaatggaagatactgatgaaataaaagcacatgatcctttaattgccggtttgatcgataaaaacatgcagaaaaacaaatttacaaataaaggagtaaacgacaatcatacttccaaaaatttcacaaaagaaggagtagaatccacaaaagatctaaaaaatagcacaacaaaaattaggcctcaccctgttgatgagtgcgttgggaaagaaataaaaagacaacgtatcatgagaggtatgagtcaaaaccagcttgcaaacaaattaggaatcactttccaacaagtacaaaagtatgaaaaaggaacaaaccgtatagtgattagcaggctatatcaacttgcaagcgtacttaacgttgaagtaagagatataatgttaaagttacaggaagatctaaaaaatatttcatgtgatcacactgttgcatctacatctactcttaaagataacgaggaaaagtttataccagagtttcacgatagcaaaatagatagcaaagaagttttaatgatggttagagcatatacttgtataaaaaatgaaaaagtacgtaacataatttacaatttggttaaggcattgtctttagataacaaacagtaagttataaaattgtatcttatatatacaagtatgctaataaattaaagctttcataattgtaatgcattaacaatgatttattttataatattaacctataagtaaaccaggtattgtcattcagtatattaataaggttttatttgtatattattgaagtattacttttgacttgaagcatgattttaattaatatgaaactgttctatcatttggataatattatgactaaattctcagctataggaattgtactttctctagtaacattattcgcatgtaatgtatttgcatcaccgattcctattgatttctctaatgaaagcgaaacagctgggttttacgcaagcggacattacaacatacagttccctagatttagtccaatatccgtcaaatataaaacagatgaaaatacagaaaaagaactaactctatttacattaaaagaaagtactgatactccaactttcaaacagaaaagtgagttcaacgacaaaaaaggttacagccctatatacaatagaaattatacaggattttcaggagctatcggatattcaggaggaggtcttagagttgaattagaaggagcatttacaagatttgatgtcgataaacaaaaatataaaaaggataactatagatattttgcattatgtaaaaaagatagtatagagagtacagataacagtaatggcaaccatgtcgtcatgaaaaatgaaggatttagagttatttctttaacattcaatgcttgttatgatatgatagttagtaattcctctttagtgccaagcgcttgtattggtatagggcaaggaataactaactttttaggaggaacaaacatccataccctatttaaagcaaaactaggcttagggtttctaatctcaccaaaaactgttatattcgccaatgggtattatgtaaaaacaaaagacaattctttcactaacctatcagttcagtacccccttgaacttaaagaagcaccaaaacatatagaccctatagcttgctttaatgcagacaactatggtggtgaagtcggtcttagatttattctataatctgactatagcaacatattaacaacaacatagttttagtaaagctaattctactataaagtaagttctgtgtacatagcatattctcacgttataataactttatcacgtgatataaaaataaaacaggtgatagcaggaaaactatcctatcatggcaaacttatattagacacttatcaaaaacaatttaagaatccataaatgaaatttgttcttaaatacacatttacatgttatgtaatcttgttttatactttataaatttgttttttatttgactaaatattttttatagaataaaacaatcattgtgtattaccgtttcacatttataacaaatgcttaaattatgccgtaaacataacaatcgattattagttttgttgacttaattcttttttagtatatttattttgctgtaagtgtgtggttctttaaaaacaattattaaggtttaggtgtatgagtaaaaggagtaacagaaagtttgttttgtgggttatgttaatattatttacaccacatatttctttagcatcagttttaaatgaccataattctatgtatgttggtattcagtacaagccagccagacaacacctatcaaaacttcttataaaagaaagcgcagccaacactgtagaagtttttgggttaaaaaaagacttactaaatgatctattaactggtattaaagataatactaattttaatataaaatacaacccatattatgaaaataatcgtttaggtttttccggtatatttggatattactataacaaaaatttcagaatagaatctgaactttcttacgaaactttccacataaagaacaacggatataaaagaattgattgtgaaaagcattttgctcttgcaaaggaaataagcggtggtagtaacaatcctgccaataataaatatgttaccctaataaataatggtatttcacttacctcagctctgatcaacgtttgttatgatgttgacggacttaaacataatataataacgtattcatgtttaggatttggagtagacacaattgattttctcagtaagtatactacaaagttttcataccaaggaaaattaggagctagttatactgtttctcctcaagtatcggtttttatagaaggttattatcatggtttatttggtaaaaaatttgagaaaattcctgtaaattatccatgtgactatccatcaccaacaccaccaaacagcaagccacatgttcacactacagcattagctatgttaagtattggatattacggtgggagtattggaataaagtttatattataaaaatattttttgacaaatttatatttgtgtttatatgtatataggtatataataaagttttagtgtgtctattgctcattaagtgagtgtgttaaaagggttatgcatgaataataaaaaatcaagaggtcaggtcttattatttgcagcttatagcatctttaagtatattaatagctgcacaagtaagtttaggctaagtgtaaaatgttttgtttataatcctttaaagtatttttattacaaaagcactttcttaaaactaggaaaatttttcgtaaattacaactatagtaaaacatcaaattacctacataggagtttattcaaactttttggtattataagaacaaccaattttaaaatttcttatttaaatttttttactaaccctagagtattgataatatactataagatactaaaaaataagtgtaacaattcttccatcaattatcttttgaataagtatactatcaatcctacagcaactagttttatcaatagtgttattatagggatataccctggttttgttaattataattattaaggttatattatgagctatgcaaaggtctttatattaatatgtttaatattgcttgtgccttcattatcctttgcaattgtaaacaatgatttcttaaaggacaatataggtcatttttatataggaggacaatataaaccaggtgttccacgttttaatagatttttagtaactaataacaacataagagagctaatgtcctcagatgaagagtgtagaagtactatacctcacatggtgcaaagtgtagcacaaggtactttaccacctgaagcgttggaagagcttgcaaaaggattgctacatggaggttatcttttttttactttaccttataaccctacatacaagaaaaatttattaggtgcaggtggtgttatagggtattcaaccactcattttagagtagaagttgaagctttttatgagaagttcaatttaactgcccctgcaggataccttcataaaaatttttacgagtattttgctttagcaactacaatggatactaaacatccacatcaatctgcagaagataaatattattatatgaaaaacacaggtattactttatcaccttttataattaatgcatgttatgattttattttaaaaaagacacgcaatgtagctccttatttatgtcttggggttggtggtaattttattgattttctagatcaagtaagctttaaatttgcttatcaagctaaggttggtattagttattttgtttctccaaatatagcattctttattgatggatcttttcatggacacttaaataatcaattttctgatttgccagtagtagattactcatcttccgggttcccaactatatcagcaaaatttaacgccaattttcttactagcagtatcggaatcaggtttatttcttaaatagtaggtcgtatttatgcagaagttatatataagttttataatattatctgggctgttattgccaaagtatgttttttgcatgcaccaaaacaacaatatagatggatcttatgtaacaataaaatatcaattaaccactccacattttaagaatttctatattaaagaaactgattttgatacacaagaaccaattggattagctaaaattacagcaaacactaaatttgatactttaaaagaaaattttagctttagcccactacatcaaactgattcttataagtcctatcaaaatgatttattagggataggtttgtctgttggactgtttgtaaaaagttttaggatagaatttgaaggagcatacaaaaatttcaatacaaagcgccttgcacgttataaatccaaagacgggtataaatactttgctataccacgtaagtcggagcatgggtttcttgacaatacctttggttacactgtagcaaaaaacaatggtatatctattatatctaatataataaatttatgtagcgaaacaaaatataaggcctttacaccttacatatgtataggcgttggtggagattttatagaaatttttgatgtcatgagaataaagtttgcttatcaaggtaaagttggtgttagctatcccattacttcaaagttaattctctccattaatggacagtatcataaggttataggaaacaaatttgaacttttaccagtttaccaacctgttgaattaaaaagactagttacaaacaagactagcaaagatatagatcaagatgtcactgcatcattaacccttaatctagaacattttagcagtgaaattggattaagttttatattttaaagtgaaggaaatatgtatatgtataacaaaaaacactattgctatatagtaacatatgttataacactattctttctattgttacctatagaatctttgtcagcattaataggcaatgtagaaaaggatttaaaagtttctagtacatatgtcagtagtcaatataaacccagtatttttcactttagaaatttctcaatacaagaatctcaccctaaaaaaagttcagaagaattcaaaaaaataaaggctaatctaaataatatactcaaatcaaacgcttataacctacagtttcaagataataccactagttttagtggaaccattggctacttttctaagggactaagacttgaagcagagggttgttatcaagagttcaacgtaaaaaattccaataactcactaataataagttcaaataaataccattctagaatacatgatgaaaattatgctattacaacaaataataaattatccatcgcatctattatggttaacacctgctatgatatttcaattaataatacatcaatagtaccgtatttatgcacaggcattggtgaagatcttgtagggctttttaatacaatacattttaaacttgcatatcaagggaaagttggaatgagttatttgataaataacaatatcctattattttctgacatatattatcataaagtcatgggtaacagatttaaaaatttgtacatgcaatatgtagctgatcctaatatttctgaagaaactatacctatattagcaaaacttgatattggttattttggaagtgaaattggaataaggtttatgtttaactaagtaaggttatatactatgacaaagaaatttaattttgtaaatgttatattaacatttttgttatttcttttcccacttaagtcatttacaacatatgcaaataataacacaatcactcaaaaagttggattgtacataagtggtcaatataagccaagtattcctcatttcaagaatttttcagtagaagaaaatgacaaagtagtagatttgataggtcttacaactgatgttacatatatcacagaacatatattacgagataatacaaaattcaacactcattatattgcaaagttcaagaacaattttataaatttcagcagtgcaattggttattattctgggcaaggaccaaggttagaaatagaaagctcttatggggattttgatgttgtaaattataaaaattatgcagtacaagatgttaatagatattttgctttagtacgtgaaaaaaatggttcaaatttctctccaaaaccacatgaaactagtcaaccctctgacagtaatcctaaaaagtctttttatactttaatgaagaataatggggtatttgttgcatcagtaataatcaacggttgttatgatttttcttttaataacacaacaatatcaccttacgtatgtataggagttggaggagattttatagagttttttgaagtaatgcatatcaagtttgcttgccaaagtaaggttggtattagctatccaatatctccctctattactatttttgctgatgcacattatcacaaggtcataaataataaatttaacaacctacatgttaagtattcatatgaacttaaaaactcacctaccattacctctgcaacagccaaactaaacattgaatattttggtggtgaagttgggatgagatttatattttaaataatcaaataaggaatttttatgagcaaaaaaaagtttattacaataggaacagtacttgcatctctattatcattcttatctattgaatccttttcagctataaatcataatcatacaggaaataacactagtggtatatatattacagggcagtatagaccaggagtatcccattttagcaatttctcagtaaaagaaactaatgttgatacaatacaactagtaggatataaaaaaagtgcgtcttctatcgatcctaacacttattcaaactttcaaggtccatatactgttacatttcaagataatgctgctagtttcagtggagcaattggatattcttaccccgaaagtctaagacttgaacttgaaggttcttacgaaaaatttgatgtcaaagatcctaaagactactcagcaaaagatgcttttaggttttttgctctagcacgtaatacgtctactactgttcctgatgctcaaaaatatacagttatgaagaataatggcttatctgttgcatcaatcatgatcaatggttgttatgatctatcttttaataatttagtcgtatcaccttatatatgtgcaggtattggtgaagatttcattgaattttttgatactttgcacattaaacttgcttatcaaggaaaactaggtattagttattacttctttcctaagattaatgtatttgctggtgggtactatcatagagttatagggaataaatttaaaaatttaaatgttaaccatgttgttacacttgatgaatttcctaaagcaacttctgcagtagctacacttaatgttgcttattttggtggtgaagctggagtaaagtttacattttaaataatatgtgggcagttctcatatgatatataaagaaaaacttactagagtgggagaatatatcttagcatatttatcatttattctttctacttatatctttctagtgctggtaaatattattagatataacagccttgctatatgtgttatcagtctactaagaactaatatctttaacgttagcacaaaaaaattaataaaagataaatgtcgtgatactaagtttagtaacatgaattgttatttgtacggtaaaccgttaaatttacaaattttttatggaatattttcctttattagaaactttcaaaataacacactaataattcctaatgatagtaaatgcggcttctataccacgttatgggataatccagcactacattatacatatacacttactggcagtgagtaccgtaatttttttgacattctatatgaaaacattatctgtcaatgtaaattacttattaactataaccgttctgtattaaaccaacataataaaaatactctcgtaataataccaatacctaatgctagagagttcagtaatgaaattcgagtaaggaatatatcaataaataaggaaagttcttatgagtgctaaaaaaaagctttttataatagggtcagtgttagtatgtttagtgtcatacttacctactaaatctttgtcaaacttaaataatattaataataacactaagtgcactgggctatatgtcagtggacaatataaacctactgtttctcactttagtaatttttcacttaaagaaacttatactgacactaaagagttattaggactagcaaaagatattaagtctattacagatataacaacaaataaaaaattcaacattccttataacacaaaatttcaagataatgctgttagcttcagtgcagctgttggatatatttcccaagacagtccaagggttgaggtagaatggtcttatgaagaatttgacgttaaaaatcctggtaattacgtagtaagtgaagccttcaggtatattgctttagcaagaggaattgataatcttcaaaaatatcctgaaacaaataagtatgttgttataaagaacaatggcttatctgtcgcatccattataatcaatggctgttatgatttttctttaaacaatttaaaagtatcaccttacatatgcgtagggtttggtggggacattatagaattttttagtgctgtaagttttaaatttgcttatcaaggtaaggtaggtatcagttatccattattctctaatatgattatatttgctgacggatattaccataaggtcataggaaataaatttaacaatttaaatgttcaacacgttgttagtcttaacagtcatcctaagtctacttttgcagtagctactcttaatgttgagtatttcggtagtgaatttgggttaaaatttatattttaaggagttttatgagtaaaaaaaattttattacaataggagcaacacttattcatatgttgttacctaacatatcttttccagaaactattaacaataacactgataaactttctgggttatatataagtgggcaatataaaccagggatttctcatttcagcaaattttcagtcaaagaaatctataatgataacattcaactaattgggttaagacacaacgcaatttctactagtacccttaatattaatacagattttaatatcccctataaagtaacatttcaaaataacattaccagctttagtggagctattggttattctgatcccacaggggcaagatttgagcttgaaggttcttatgaagaatttgatgtgacagatcctggagactgcttaataaaagatacctatagatatttcgctttagctagaaacccatcaggttctagccctacctcaaacaactatactgttatgagaaatgatggtgtttccattacttctgttatatttaatggctgttatgacatctttttaaaggatttagaagtatcaccttatgtatgtgttggtgtaggtggagattttatagaattttttgacgcattacacattaaattagcataccaaggcaagttaggtatcaattatcacttatcgactcaagcaagcgtatttattgatggatattatcataaggttataggaaatcaattcaacaatctaaatgttcaacacgtggctagtacagattttggacctgtatacgcagtagccacacttaacattggttattttggtggtgaaatcggaattagacttacattttaaaggaatattatgaataatagaaaaagtttttttataataggtgcatcattactagcaagcttattattcacatctgaggcctcttctacaggaaatgtaagtaaccatacttattttaaacctaggttatatatcagtggacaatatagaccaggagtttctcattttagcaaattttcagtcaaagaaaccaactacaatactactcaactagttgggcttaaaaaggacatcagtgtcatagggaacagtaatatcacaacctacacaaatttcaactttccttacattgcagaatttcaagacaatgccataagtttcagtggggcaattggatacttgtattccgagaattttagaattgaagtagaggcttcttatgaagaatttgatgttaaaaatccagaaggatctgctacagacgcatacaggtattttgcactagcacgtgctatggatggcactaataaatctagtcctgatgacacaagaaaattcactgtcatgagaaatgacgggttatcaatttcatcagtaatgataaatgggtgttacaattttacattagatgatataccagtagtaccgtatgtatgcgcaggaataggaggagatttcatagagttttttaatgatttacatgttaagtttgctcatcaaggcaaggtaggtattagttattctatatcccctgaagtaagtttatttcttaacggatattaccataaagtaacaggtaacagatttaaaaacttacacgttcaacacgtaagtgatttaagtgacgctcctaagttcacatctgcagttgctacactcaatgttgggtactttggtggcgaaattggagtaagatttatattttaattataactaaatacggaagatctaatgaataaaaaaaacaagtttattatagctacagcattggtatatttactgtcattacctagtgtatcgttttcagaggttacaaacagcagtattaaaaaacactctgggttatatattagtggacaatacaaaccaagtgtttctgtttttagtagtttctcaattaaagaaactaacactatcacaaaaaatcttatagcgttaaaaaaagatattaactctcttgaagttaacgccgatgctagtcaaggtattagtcatccaggaaattttactataccttatatagcagcatttgaagataatgcttttaatttcaacggtgctattggttacattactgaaggtctaaggattgaaatagaaggttcctatgaagaatttgatgctaaaaaccctggaggttatggtctaaatgatgcctttcggtactttgctttagcacgtgatatggaaagcaacaagttccaaccaaaagcacaaagctcacaaaaagtatttcacactgtaatgaagagtgatgggttatctataatatctatcatggttaacggctgttatgatttttcttcggataatttattagtatcaccttatatatgtggaggtataggtgtggatgcaatagaattttttgacgcattacacattaaacttgcgtgccaaagcaaattaggcatcacttatcaattatcttataatatcagcttatttgctgatggatattatcatcaagtaataggtaaccaattcagaaatttaaacgttcaacatgtagctgaacttaatgatgcacctaaagttacatctgcagttgccacacttaatgttggatatttcggcgctgaagttggagtaagatttatattttaattacaattaaatacggaaaagttcatgaatcacaaaagtatgctctttacaataggtacagctttgatatccttattgtcattacctaatgtatcattctcaggaatcataaataacaatgctaacaatttaggtatatacattagtgggcaatataaacccagtgtttctgtttttagcaatttctcagtaaaagaaactaacttcactacacaacagttagtagcacttaaaaaagatattgattctgttgacattagtaccaatgctgatagcggtattaataatccgcagaatttcactatcccttatataccaaaatttcaagacaatgctgctagttttagtggagcacttggattcttctacgctagaggtttaagacttgaaatggaaggttcctatgaagaatttgatgttaaaaaccctggaggatatacaaaagtaaaagatgcatatcgttactttgccctggcacgtgagatgcaatctggtcaaacttgccctaaacacaaagaaacatcaggtattcaacctcacggtatttatcacactgttatgaggaatgatggggtatctatttcatctgtcataatcaatggttgttataactttactttaagtaatctaccaatatcaccttacatgtgtgtaggtatgggaatagatgctatacaattttttgattcactacatattaagtttgcacatcaaagtaagttaggtattacttacccactatcttcaaatgttcatttatttgctgatagctattatcataaagtaataggtaataaatttaaaaatctaagggttcaacacgtttatgaattacaacaggtacctaaagttacatctgctgttgctacacttgatattgggtattttggtggtgaagttggagtaaggtttatactttaattataactaaacacggaaaatttcatgaagaagaaaaatcaatttatcacaataagtacaatattagtatgtttattgtcattatctaatgcatcactttcaaacactacaaatagcagcactaaaaaacagtttgggttatatgttagtggacaatacaagcctagtgtttctatttttagcaatttctcagtaaaggaaactaattttcctacaaagtatctagcagctcttaaaaaagacattaattctgtcgaatttgacgatagtgttactgctggcattagttacccacttaatttcagtactccttatatagctgtatttcaagataatatttctaattttaatggcgctattgggtacacttttgttgaaggcccaagaattgaaatagaaggttcttatgaagaattcgatgtcaaagaccctggaagatatacagaaatacaagatgcataccgttactttgctttagcacgtgatatagactctattcctactagcccaaaaaatagaacttcacatgatggcaacagttcatataaggtataccacactgtaatgaaaaatgaaggactatctataatatccattatggtcaatggctgctatgatttttcttcagataatttatcaatattaccttatgtatgtggtggtataggtgtaaatgctatagagtttttcgatgcattacatgttaaattcgcgtgtcagggtaaattaggtattacttatccattatcttccaacgttagtttatttgctggtggatattatcaccaagtaatgggcaaccaatttaaaaatctaaatgttcaacatgtagctgaacttaatgacgcacccaaagttacatctgcagtagctacacttgacattgggtattttggtggtgaaattggagcaaggcttatattttaattataaacaaatatggaaaatctcatgaataagaaaaacaaattctttacaataagtacagcaatggtatgcttattgttattacctggtatatcattttcagaaactataaacaacagtgctaaaaaacagcctgggttatatatcagtgggcagtacaaacctagtgtttcagtttttagtaatttttcagtaaaagaaactaatgttcccacaaagcagttaatagcacttaaaaaagacattaattctgttgcagttggtagtaatgctactacaggtattagcaatccaggtaatttcacaattccttatactgcagaatttcaagataatgttgccaatttcaatggggctgttggttactcttttcctgatagtctaagaattgaaatagagggatttcatgaaaaatttgatgtcaaaaaccctggaggttacacacaagtaaaagatgcgtaccgttattttgcactagcacgtgatttaaaagatggcttctttgaacctaaagcggaagatacaggtgtttatcatactgttatgaaaaatgatggattatctattttatctactatggttaacgtctgttacgatttttctgtagatgaattaccagtcttaccttatatatgtgcaggtatgggtataaacgccatagaattcttcgacgctttacatgtaaaatttgcttaccaaggcaaactaggtattagctatcaactatttactaaagtaaatttattccttgatgggtattaccatcaagtaataggcaatcaattcaaaaacttaaacgtaaaccatgtttacacacttaaagaatctcctaaagtcacatctgcagtagctacacttgacattgcatactttggtggcgaagttggaataagattcacattttaattgctcaaccataaaataatgggaaattaccttttctaggaagtttctcattatttaacagttaactttctgtaaacttctaataacagtattttgttcactcttccccttaataaaaatcataagtttacaataatgtcaaaaagatttctttttaaacacatttaaaatggctaaaccgttttctgctttattagaatgattcccaaataaattttaattaattactgttccgtatttattaatatatgttataatgtaattaaataaggatactagatttgctcataatgcatgtactgaatttgtgatttgaaataacaagacttaaatgtcgaatttagcttctgtcctagtggataagtactttagcaagtggtaaaagcaagtctactcatatttttattaattaagtagtaaagttaactatagattttattaaaatttttattctaatcactttaaatatcaattacttttgttgtaaatttgaaagaaattttatattctagacttgcttttctttatttctttcattattcttaaatttttattatcttttataaaaggtttattaacatgaattacaagaaaatttttgtaagcagtgcattaatttcattaatgtcaatcttaccttaccaatcttttgcagatcctgtaacttcaaatgatacaggaatcaacgacagcagagaaggcttctacattagtgtaaagtataatccaagcatatcacacttcagaaaattctcagctgaagaagctcccatcaatggaaatacttctatcactaaaaaggttttcgggctgaaaaaagacggagatatagcacaatctgcgaattttaacaggacagatccagccctcgagtttcagaataacctaatatcaggattctcaggaagtattggttatgctatggatgggccaagaatagaacttgaagctgcataccaaaaatttgatgcaaaaaatcctgacaacaatgacactaatagcggtgactactataaatactttggactatctcgtgaagacgcaatagcagataagaaatatgttgtccttaaaaatgaaggcatcacttttatgtcattaatggttaacacttgctatgacattacagctgaaggagtacctttcataccgtatgcatgtgcaggtgtaggagcagaccttataaacgtatttaaggattttaatttaaaattctcataccaagggaaaataggtattagctatccaatcacaccagaagtttccgcttttattggaggatactaccacggagttataggaaataattttaacaaaatacctgtaataacacctgtagtattagaaggagctcctcaaaccacatctgcgctagtaactattgacactggatactttggcggagaagttggagtaaggttcaccttctagttttatttatttgttattatatataataaatagtgaaaaaaatttagcaattcataataatagggaaaatgtgaagttatttcaagttttcccttatgtattttatattagaagatattcttgccatgtatttctacaattgtatatggtttctaggaatagatgtttttcgtgcacgcataaaacgtattaaatttctcttacaaagactacttatgtattatagtaaaaactagcttataacttgtttttacattgtagttctactattgttaatttattttcactattttaggtataatatgaactgcaaaaaattttttataacaactgcattggcattgccaatgtctttcttacctggaatattactttctgaaccagtacaagatgacagtgtgagtggcaatttctatattagtggcaagtacatgccaagtgcttctcattttggagttttctctgccaaagaagaaaaaaatcctactgtcgcgttgtatggtttgaaacaagattggaacggtgttagtgcttcaagtcatgctgatgcggactttaataacaaaggttattcttttaaatacgaaaacaatccatttctaggttttgcaggagctattggttattcaatgggtggtccaagaatagagtttgaagtgtcctatgaaacatttgacgtgaaaaatcaaggtggtaattacaaaaatgatgctcacagatactgtgccttagatcgtaaagcaagcagcactaatgccacagctagtcactacgtgctactaaaaaatgaaggactacttgatatatcacttatgttgaatgcatgctatgacgtagtaagtgaaggaatacctttctctccttacatatgtgcaggtgttggtaccgatttaatatccatgtttgaagctataaaccctaaaatttcttatcaaggaaagttaggtttgagttactctataaacccagaagcttctgtctttgttggtggacattttcataaagttgcaggtaatgaattcagggacatttctactcttaaagcgtttgctacaccatcatctgcagctactccagacttagcaacagtaacactgagtgtgtgtcactttggagtagaacttggaggaagatttaacttctaattttattattgccacatgttaaaaataatctaaacttgttttcattattgctacaaataaataaaatagtggcaaaaaaatgtagcaataagaggggggggggggactaattactatctgccatatcccttactaccacttacactaaataatctgacaaatacaacagcttctggagaaataaacaatatttaaatttttcttacaaaaaccatttatatcttgtactaaaaactagcttataacttgtttttacattgtaggtttactactgttaatttgttttcactatttcaggtgtaatatgaactgcgaaaaattttttataacaactgcattaacattactaatgtccttcttacctggaatatcactttctgatccagtacaggatgacaacattagtggtaatttctacatcagtggaaagtatatgccaagcgcttcgcattttggagttttttctgccaaggaagaaagaaatacaacagttggagtatttggaatagagcaagattgggatagatgtgtaatatctagaaccactttaagcgatatattcaccgttccaaattattcatttaagtatgaaaataatctattttcaggatttgcaggagctattggctactcaatggatggcccaagaatagagcttgaagtatcttatgaagcattcgatgttaaaaatcaaggtaacaattataagaacgaagcacatagatattatgctctgtcccatcttctcggcacagagacacagatagatggtgcaggcagtgcgtctgtctttctaataaatgaaggactacttgataaatcatttatgctgaacgcatgttatgatgtaataagtgaaggcatacctttttctccttatatatgtgcaggtattggtattgatttagtatccatgtttgaagctataaatcctaaaatttcttatcaaggaaaattaggcttaagttaccctataagcccagaagcttctgtgtttattggtggacattttcataaggtgataggaaacgaatttagagatattcctactatgatacctagtgaatcagcgcttgcaggaaaaggaaactaccctgcaatagtaacactggacgtgttctactttggcatagaacttggaggaaggtttaacttccaactttgattattgccacaataaataaaaatagtggcaaaagaatgtagcaataagaggggggaggggggaactaaattattatttgccatatcccttactaccacttacaccaaataatctgacaaatacaacagttcaaacaaaggtaaacaattcttaaatttgtcttatgagaaccattgatatcttatattaaaaactagcttataacttgtctttacattgcagttctactattgttaatttattttcactattttaggtgtaatatgaattgcaaaaaattttttataacaactgcattagtatcactaatgtcctttctacctggaatatcattttctgatccagtgcaaggtgacaatattagtggtaatttctatgttagtggcaagtatatgccaagtgcttcgcattttggcatgttttctgccaaagaagaaaaaaatcctactgttgcattgtatggcttaaaacaagattgggaagggattagctcatcaagtcacaatgataatcatttcaataacaagggttattcatttaaatatgaaaataacccatttttagggtttgcaggagctattggttattcaatgggtggtccaagagtagagtttgaagtgtcctatgaaacatttgacgttaaaaatcagggtaataactataaaaatgatgctcacagatactgtgctttaggtcaacaagacaacagcggaatacctaaaactagtaaatacgtactgttaaaaagcgaaggattgcttgacatatcatttatgctaaatgcatgctatgatataataaacgagagcatacctttgtctccttacatatgtgcaggtgttggtactgatttaatatccatgtttgaagctacaaatcctaaaatttcttaccaagggaagttaggtctaagttactctataaacccagaagcttctgtatttattggtggacattttcataaggtgataggaaacgaatttagggacattcctactctgaaagcatttgttacgtcatcagctactccagatctagcaatagtaacactaagtgtatgtcattttggaatagaacttggaggaaggtttaacttctaattttgttattgccacatgttaaaaataatctaaacttgttttcattattgctacagtaaataaaaatagtggcaaaagaatgtagcaataagaaggggggggggggactaaattgctatttaccatatcccttattataccacttacactaaataacttgacaaatacaacagcttctggaaaaacaaacaatacttaaatttctcttacaaaaaccatttatatcttgtactaaaaactagcttataacttgtttttacattgtagttctactattgttaatttattttcactattttaggtgcaatatgaattgcaaaaaattttttataacaactacattagtatcgctaatgtccttcttacctggaatatcattttctgatgcagtacagaacgacaatgttggtggtaatttctatatcagtgggaaatatgtaccaagtgtttcacattttggcgtattctctgctaaacaggaaagaaatacaacaaccggagtatttggattaaagcaagattgggatggcagcacaatatctaaaaattctccagaaaatacatttaacgttccaaattattcatttaaatatgaaaataatccatttctaggttttgcaggagctgttggttatttaatgaatggtccaagaatagagttagaaatgtcctatgaaacatttgatgtgaaaaaccagggtaataactataagaacgatgctcacaaatattatgctttaacccataacagtgggggaaagctaagcaatgcaggtgataagtttgtttttctaaaaaatgaaggactacttgatatatcacttatgttgaatgcatgctatgatgtaataagtgaaggaatacctttctctccttacatatgtgcaggtgttggtactgatttaatatccatgtttgaagctataaaccctaaaatttcttatcaaggaaagttaggtttgagttactccataagcccagaagcttctgtttttgttggtggacattttcataaggtgatagggaatgaattcagagatattcctgctatgatacccagtacctcaactctcacaggtaatcactttactatagtaacactaagtgtatgccactttggagtggaacttggaggaaggtttaacttttaattttattattgccacatgttaaaaataatctaaacttgtttttattattgctgcaggtaaataaaaatagtggcaaaagaatgtagcaataagaggggggggggggggactagtttataagtgctgtttttctcacctttacacatgatactatacttaaccagtttttttgctattacttacctgacgtaatatattaaattttccttacaaaagttaccgatattttatacaaaaatttatattctgacttgcttttatatgacacttctactattgttaatttatttgtcactattaggttatatatgaattacaaaaaagttttcataacaagtgcattgatatcattaatatcttctctacctggagtatcattttccgacccagcaggtagtggtattaacggtaatttctacatcagtggaaaatacatgccaagtgcttcgcattttggagtattctctgctaaggaagaaagaaatacaacagttggagtgtttggactgaagcaaaattgggacggaagcgcaatatccaactcctccccaaacgatgtattcactgtctcaaattattcatttaaatatgaaaacaacccgtttttaggttttgcaggagctattggttactcaatggatggtccaagaatagagcttgaagtatcttatgaaacatttgatgtaaaaaatcaaggtaacaattataagaatgaagcacatagatattgtgctctatcccataactcagcagcagacatgagtagtgcaagtaataattttgtctttctaaaaaatgaaggattacttgacatatcatttatgctgaacgcatgctatgacgtagtaggcgaaggcatacctttttctccttatatatgcgcaggtatcggtactgatttagtatccatgtttgaagctacaaatcctaaaatttcttaccaaggaaagttaggtttaagctactctataagcccagaagcttctgtgtttattggtgggcactttcataaggtaatagggaacgaatttagagatattcctactataatacctactggatcaacacttgcaggaaaaggaaactaccctgcaatagtaatactggatgtatgccactttggaatagaacttggaggaaggtttgctttctaacctggcagtgtgtagtttctattttagtgtgatttctacaataaaaggtaagttgagttcattataggtagctagtaattatttttttcataaacctagtttttttacacacattgtaattattagttaaaagtaaacagagcttttacagtactttattagttttagcataaaaactacttagagtctttatgtagcaagatatagaacgcggtttattatgtaaaacacaagccaccagtctacagttacacaacagcataactgtagcagtacagaaataatgtaaggcatatacctacaccaaacaccaaaattagaagttccaattaaccaaaacaaactgtaatgtaaagtcttattatacaatataaggacaaaaaatttatgtttataaaatcctatagtgtaaatctcataccaacttcccaaccaaaataatcagtatctaaagtagcagatgctgaagtagttttaggcacattcgttaatgtggcaggatgataagctatttctactctttcatacctattacctataaccttatgataataacctccaccaaataacataacattaacactcacaggatagttaaccccaaatttcacttgataagaaaatttaggcaatgatattcccaaaaattttatgtaatctgctccaacaccagcacacatatatggtgctaaaggaatactaccatgagcaatatcataacaaaagttcacattaagagatttatcaataacaccatcattttctaacactataaacttattatcttgaacagtggactcacgagatagagcaaaaaacttatggctttctcctccttcaggataccactgtctttcgggttcaaaattttcataagcaccttcaaactctactctaaaatcattaacataatatccaataacaccaccaaacccagcaaaattgcttgcatatgtaggattatacgcttgtgtaaaacctgcatggtcactaatgctagatttatcaaggcctaaagcaaaaatactttttgtgagtccaggaagtgtttcttcagctgaaaaattactgaaattaggaacaccaactttatattgagtacctacataaaatccctttctcccttcaggaacgtttgcatcagaaaaagaattatcaggcaagaaagaaagcaatgtagccaatgcaacacctacaacaaattttttgtaattcatcttacatccattaataacaaggtaaactatggtaatttactatgacaaaccatgccaagtcaagtaattgtacacaattccacttattacataataaatgcataacagtaatacacaggaatgaaattttacctttctcaatagtcagctacatgtaagatatttcagctgttttggtaattctatacaaatacctttataccaatttctgcaccaaaatattccatatccagcttagctgctgttgaaatattaagaggattgggtaaggatacatattgcacaggaatattattatactcattaccaaccactctatgataatatacatcaaaaaataacaacatatcctgagacattaaataattgattccaagtttactgttaaaagaaggtttaaatctaattgagtcaaaaattttaataatatcttctccaatacccacacaagaaaaaggaacaatattagtatcaactgcaaaatcgtaacaaatatttagtatagttgaatagaattctacaccatcattttttaaaacaaaatagtcatacaatgtaggtggattggatctgactaaagcaatgtgcctataattattatctactaaatgatttctagtatctatcacatcaaatttcttataagatccttcaagttctactcttaaattcctaaatgaatacccaaatataaaagacaatccaaaaatattattgtcatattttggaacatattcttctgagaaattgaagttattaaaatctttcatagctttatcagcatctaataaaatatcactttttaagcctacaaccctatcagtttttacaccatttatcctatatgtttcacctatcgaaaaactactaaacagaggagcactcaatttataagaaatccctagaaaaacaggttttaacctgctgttcaaagaatctgatacatctaatgaacctgaaaaacaacaacaaggtaccaataataacatcaatattattactgaaatcctatatctcataagttaatttacccagtaacaataaataattattaattatatagtaaaaatattaataatataataaaggtaaatttacttatgcacatattttattagatacatttttaaagcattcatatacaattgctatacacaactcagatcataaaacagaaatcctatacacacaacaccattcaaaacataacaatcaaaatcatattataaatactaaagctgttttacaccattaaactttacaaaaactaatataactttactataaatactctgttctattaggtgagcgtcttgtaataaaactgatatacatatgtataagcgatatatgtaccagtagatgatattttagagtaatactgtaccccttcaatttgcaagaaaaccatagggataagatagaaaaaatattgtttttatacattaactagtatatataggttatacacgtgttatttaatgttaggtaaaacaatgaatgatttagatctttataatgaaacaaacatatcaacagagactgcagattacagtcaccttcctacttcacatttaatgaatgcactcaatcatgactgtgtttctaggtttgaagttaaattatctccaacatctgtggataatgaatactctgtcgaattcacatttgaacaatataaaaacaatgcagaacaagatctattgaaattaatagtaggagaatttggagttaattttgacccagaacatcataagttatctttaatcgatggtgatacttctgtaatactagaagaagacatgataaattcatgtttaagttgcataaaggtagtacaaaaagaccattctgcagaataatctacgtatttttatatataaaaattttaataaggaagggcctattttttattgactcacaaaaagtttactaattcaaatagggtcctttcacataattcatcgattacttaccctaaatacaacgcacatttcatgtactaatcagcaggttgaaaacaacgtgtgatcagatcacctgtacaatattaatttactatactacttaaattaaatttgtgacatatcaggattataaactattttatctcaattctcacccaaaatgtagcattattacatattcatatttaaaaatttaaatataagtatcttaagtaaactttgatatacattattcctgattcgaaagaaatagtttaggatctttggtaatttattttttttatcaaacaaaatatattgttttattatattaacaagatataataacactattaataaaatttaggtaagctataatggatatttttggcaatgaattcgatgttcacgttaacgcaaacggaacagagtacgcaggaaaaatgagtatagacagcaatggtgatttcgatgtcaatctcgacttacaagatggtgtgggaactttaggccatctctctggacacatatctcaaagtgacgatgctgctaattatattattgagtatatatttgaccaatgtataatttatccagaattacctgttttacattcatttaatggacaaatagtatctcctgctgaagaaggtagcattatttttgacaatggtgataacattcaaatttcattacatggcttacaagagcaaccagaagaagctatacctgctgcagaagtagaagaagctgtaccagcagaagcagctatacctgctgcggaagtaacagaaaatcaacaataatacttttcgtaggtatctttgttttttattaaaaattagttaataaataaatacttgtaaggtggatgcttggtttttgcaagtattcacattataagtagtaatgttgagatgtgttggaattgatttagtagactcttttatattcatgtagggattaacatctttatgagtttggctattttctaaaaaaattttcacatatatcgtctaatttataagtcttgtattagtcatcatagtactttatgcataatcaactacatgagattatcgtgttacatatgattcttgacaacatatgaaacccgaaaacatttacatagcctattgctaattttgttgtacttttatcttatttaatcatataattcacaacctaataaattaaatgttaatttaattatgctcagtattgcacacaagatctttggctcaacaaacagcaggataataaaatcatttcataaagtagttcaggatataaatgcaatagaacatgagattcaacttctttctaatgaagcattaaaacataaaaccatagaattcaaagaagaactcaaaaatggaaaaaccttagatgatattctagtaccagcctttgctgtggtaagagaagcctcaaaaagagtactaaatatgaggcactttgatgtacagcttataggtggaatagtcctacataaaggaatgatatccgaaatgaaaacgggcgaaggaaaaactttagtagcaacactagctgcatatttaaatgcattagaaggaaaaggagttcatatagtaacagtaaacgattatctagcaaaacgtgacgctgaatggatgggagaattatacagtgcattaggaataacagttggatgtatactcactgaaacaaatgacttagaaagaaaaaacgcttataactgtgacatattatattcaacaaacaataacctaggctttgactatttgcgtgataacatgaaattttctagagatgaaatggtgcaaaggggatttaattacgcaatagtcgatgaggtcgattcaatattaatagatgaagcaagaactccactaataatctccggacaagtcgaccaagatatcaaaatgtataaaaaaatagataatctgatatatgaattagcagaagaagattatgaactagaagaaaaaaacagaaatatctttttaactgaagccggaataacaaaaattgaaaatttattaatccagcataatcttatttcttccaatacatctttatacgacatagataacatcataatcatgcactacatcactcaagcattacgtgcgcataaaatgtttgctgtagataaagattatataattaaagacggcaacatagtaattatagatgaattcacaggccgtatgatggatggaagaagatattcagacggattgcatcaagcccttgaagcaaaagaaaaattaaatatcaatagtgaaaaccaaacactagcttctactacatttcaaaattacttcagaatgtacacaaaactctctggcatgacaggcactgcagaaactgagtcagaagaattcttaggaatatataacttacaagttgtacaaattccaacaaatatacctgttcaaagaatagacttaaatgacgatatatattgtacagaagaagaaaaattcaattccgtcataaaatttatttcagaatgtcataaaaaactacagcctgtactagtaggaacagtcagtatcgaaaaatcagagatgctatctaaactattaacaaaaaataaattaaaacactctgtattaaatgcacgttaccatgaacaagaagcgtatataatagcacaagccggcatacctggaacaatcacaattgctacaaacatggctggtcgaggtacagatatacagcttggaggaaatttaaaaatgctagcaaaaacagcacttgctaacattacagacaaagaagcaatagaaataaaatacaaacaactcacagaaaaagtaaacagagataaagaaatagcaatacaagctggagggttatgtgtaattggcacagaacgtcatgaaagcagaagaattgacaatcaattaagaggaagatctggtagacaaggagatccagggctatccaaatttttcttatcattagaagatgacttattaagaatatttggctcagacaaaataaaaggagttcttcaaaagctaggcatgaaaaaagatgaagctattcaacacacatggataagcagatctattgaaaaagcacaacacaaggttgagtcaagaaattacgatattagaaaatctctattaaagtttgataatgtaatcaatgaacaaagaaaagttgttttcgaccaaagaaataaaattttagatagtgattcctacgatatttcaatcatatatagagatctcaatagtgatatagtaaatagtataatacatgacaagtactacaatttagacgatgatacatataaagcattatcatctgaattcacaagaatatacaatatcaccttggattacagcactatcagtaatttcgaaagtaaagacaaagttttagaacatctaaacgaaactgttgatgaacattttgcacaaaaaatagaagaatttacattaaaagatcaaaaagcatgggaccatgtagtaaaaaaagtcatgataatgtcattagattacttatggagagatcaccttgctgcactagatagtttaaaatgtgggataaacttaagatccatagcacaaaaagacccattaaatgagtttaaagctgaagcattctctatgcttgagaatatgatgagcaagttttatgaactaataatacagagattatcccatttgaagtttgatatagagttaaatgatacacaaagaatagaatataatatccatcattccaaaatttcacgtaatgaaaagtgcccatgtggatcaggaaaaaaattcaaacattgtcatggtgcttaatctttagttgcttacatattgtatgataaacacaattgtttcataccgttggtaactgcaaaactttctatcaaaggaataaactatattacaaccctaaaagtttgtctatttattcagttttataaaaccatagaaaacacacattcgatatttttatagcagaaataaaatttcataccatagccacttaattaaaaatgcatccacaaagtataataacaacacaaacaacaccaaatttattatttgtattggacaaacagaactctttatccatggatacaattcctattattccttcttcttgtccagagtagtaaaaaagacgcaagatcattatatttcattctagtataccaagctataggaggtattcacagaacaaaattatgtatctaactaatatctcaactatagcttacattttgaaatttttcgtataaaaatttatttttctatagatgccattctctcttgatcaacataaacatacttatatgtttttccttcatcttgaaaaattttataatccttattaaaagaatccctaatcatattagcatctgtaccattgtgcagaagaatacttacaacaggttcatcattaacccctgctccttttgatggatctgtcaatagcaaattatgttcatcaactaataaacaagcatcaaatccacttaatatagaaatcagaaaagttttattaatcgatgtaacattttttatatctgtcgcaggatcatgatgttcaagagtaatttgtaaatcacatttaccacaatatacatcaccataaactccatttgtaccatgatttattatattaattacacccttatcccctgttacatcattagcaatatccccactagcataatactcatctccttgagcattgatgtgcaatttgccatgataaacatcaatattagaatgaccattttgttgtattaaaaagtcaacctgacaaaaatcataatctgtattcataataaagcccacattatattacttacagatcaatataccacaattataaaaaaattaatataaatatttattttacaataaagcattaatacatattaatactagaatacaattagtattttacttacatattccaatccttattatacttataacaatattgtactatcaattaataccgcttcaacataatcaatatactatgatattttttgtagtttgcttatattataactttcaattcaagttcaattttacgttgtaaaaaatcacttttaaattattaatattaatataaatattatgccataaatttattattagttaaatatacatacttaatttattccatattaatcaaatcatttgcattattttattgacgtagtatattaagttatctttattatgtgttcagtatgtctttaaatatttgtttaccagaccaatccttactaagacccagaattacagtttttggtgtaggtggtgctggtggtaatgctgtaaataacatgatacagtctaatctgcacggcgttaactttgtagtagctaacacagatgcacaagcattagaactttccttgtcagaaaagaaaattcagctaggtatcggattaacaaaaggactaggagcaggatcacttccagaagtgggtagaggtgctgcagaagagtcaataaatgagattattgaggaaatctcagatagcaatatgctgttcataactgctggaatgggtggaggaacaggaacaggcgctgctcctgtaattgccagagttgccaaggagaacaaaattttaaccataggagttgttacaaaacctttccacttcgaaggggcacatcgaatgaggacagcagaatttgggttagaagaattacaaaggtatgttgatactctcatagtaattcctaatcaaaatctattcaggattgctaatgaaaaaacaacatttgcagatgcattcaaacttgcagacactgtcttacatacaggtgttcgtggcatcactgacttaatggtaatgccagggctcattaatctagactttgctgatattcgagcaataatgagtgaaatgggcaaagcaatgatgggtacaggagaagctgaaggagaaaatagagctatagccgctgccgaagcagctatatccaatcctctattagacaacatttcaatgaaaggcgcaaaaggcatattaattaatatcactggcggattggatatgactctatttgaagttgatgcagctgcaaatcgtataagagaagaagtagatagtcacgctaacataatatttggatcaacgtttaataaagaaagtgaagggaaaattagagtatctgtcttagcaacaggaatagataatgaagaagtagtaatacaaaataagagtgcattaaaagataaagaagctcataatgataagttatctgaaacatcaagtaaacctttcaacccgctagacaacgaaattgcttattataaaccaagcaacccgggagaagatatgattcattccataaatcatacaaaaaaacaagatcacaatatagaaaaccaaaaatccaacaataaaattcccgaatcagcttataaaatgcaatttaataagaatgaatattgggatgaggaatcatttaatataccaacttttttaagaaaaaaataaggtataatgtcctactggcttttaaaaacagaaccccaagatttttcatgggatgatatggtgcgtgataatgttactgtatgggataatgtgttaaactatcaagctcaaaattatctaaaaacaatgaaatataatgatcttgcatttttttatcactctggaaaagaaaaaggaataataggaattgtatccatagataaagaattttatttgcccaatacaaataataaatttggtgttgttgaagttaaaacacatataaaactaaataagactgtctttttgaaagacataaaatcaaatccaacattaaaaactatgttaattctaaaacaaccacgtctttcagtttctcaagtaacagaacaagaatggaattgtattttacatttaggtgagactatcttatgattgaaatcaatatttactataggaagtggtataatataataaataagccaaaaagttttataaaaaaaattattaatacttctctaatagatttaaatatttatgaatacaaacctacaatttctgttgtgctagcaaacaatagactactacaaaaactaaattatgaatataggaaaaaaaataaaccaacaaacgtactatcattcccatacaataaattaaataagtattgttatttaggagaaatttttgtttcattagacactcttataaacgaatctactgatttaaatataccaatagaacatcatacatctcatatgctcattcatggactattacatatcttagactataaccatgaagaaccattagagcaatacattatggaatctattgaaattaagttactagataaactaggcataaaaaatccttatgttccacgtgaaacataagcactaaaatttgtatttatcatcaattcacaatcaaaattcgtattatattttcattaatagtacttaagaataaaaaattcagtgacaccattctgatcttatatataatttaaaaaaacatgtaaattatctgtatgagcaaagcttttgctatagtaaatcaaaaaggtggtgtaggaaaaacaacaactagtataaacttatcaacagcttttgctatagtaaacaaaaaaactttgcttatagatttagatccacaaggtaatagtagtactgggtttggaattacctatgaacaaagaataaatacagtatatgaagtattggtcaacaatttacctatatcatcaactattataaaaactgaaataccaaatttacatttactaccatcaaccgtagatttatctgcagcagaaatcgaattaacacaagtgcaacaaagagaatttattttaaaaaaatctctatccgaagtaaaaaattcatacgactatatttttatcgattgtccaccatctttaggtttactaacagtaaatgcattgatagcagcagactcaatcataattcctctacaatgcgagttttttgccttagaaggacttagtcatctaatgaaaaccatagaaatagtaaaaaaacacctaaatccacttctatcaatagaaggaattattttaactatgtatgacaaaagaaataagctaagtgaacaagtagaagaagatattagaaaatatttaaaagaatctgtatacaaaacagttattcctagaaatgtaagactatctgaagccccatctcatggaaaacctgctattatttatgattttaaatgtgcaggttctcaagcatatatatatctagcaaaggaaatactaagaaaacaaaaaaaatattaggtattcaa

SEQ ID NO: 2 - DNA, 555 bp, Ehrlichia chaffeensis
atgctagaaagttctatgctgtgtattacacgtaaaattgtacctgtatcctcacctatcaccttatcagaagtaaaatccttcctacgcattaacaataatcaagatgatacattaattaataacttaattactatggcatctgaatatgcacaatggtatatagaaaaatcattaatgaaacaaacatgggaaatttcctgtagtagatatatacctggaaaaatacaattgttatttaatccaataataaaagtgaatcatgtaaaaataatacacacaaatggaagtgaagaattgatagatcaaaaatactatcacgttaacacagtactatcatacatttcatttaataagcatatccatggagatagaatagaaattctatatgaagcaggatatacagacaatgcgttaataccagcacaaattagatatggcatattacatcacgtcgctatatcatataaaaatagagaatcagaaaatattaataatttaacttttataaaaaatatatattcccccttccgtgaactgaagttagttttatga

SEQ ID NO: 3 - protein, 184 aa, Ehrlichia chaffeensis
MLESSMLCITRKIVPVSSPITLSEVKSFLRINNNQDDTLINNLITMASEYAQWYIEKSLMKQTWEISCSRYIPGKIQLLFNPIIKVNHVKIIHTNGSEELIDQKYYHVNTVLSYISFNKHIHGDRIEILYEAGYTDNALIPAQIRYGILHHVAISYKNRESENINNLTFIKNIYSPFRELKLVL

SEQ ID NO: 4 - DNA, 1056 bp, Ehrlichia chaffeensis
atgataataaagtttggggttgaaaatctgatcgatagtgctgtggaaatagtttgtaaatattttgatatatatcagcgaaatgatgcagtaaaacatgtattacataaatgtattaaaagtttaagaactgtagaaaagaaattaaagatatatagagggaaagaagctaaaggacatgtaattagtgatagccaatttgctgaaatggaggatctaataaaaaaagttctcatgaaggtgtttgagattgatatttcttatcaaaaacaacacttgtctgcagaaaaaatggaggagtataaagtagctgttagtcttttattggatcaaatagtaaggtgtaagtcttatgctcttaaagaaagtgatattcttcctaaggttgtagggaatgcaaccttaaaacgtagtgcatataagtgtaagcatgtagtggattttattaataagaatagatttcttcctatgaatatggggagatttgataagctttgttttgatctagatttagatcctcagattttgaaacaagttatagatttatgcagttttgctcttatatttgaaattttggatcttaagttagtacaatttcttgttgaaatgagattctttccacatcaaaacactaatgtaattagtataactaaagataattacatagaattaatgcagcatattatgctttataaatgttctcagtctattggcaaagagtatactaatgagcaagcaaggtacttaccttgtttttcacctggttatactcggggtaatgttaagggcaattcattcatatgtttaggaatagctttgtttatagcacaagctctatttaatggatttgggttattatttatgttgctgtctgaatttaagacacaaaatgattggtggtttattggcatatgtgttgttaatatgctcttagccgttactgctcttacgttgatttgtattggaaagaaacaactgagtcaaaatcatgataccttattaacggatatagatgtcagtggtattaatattgttgaagaaagtgtagatttatag

SEQ ID NO: 5 - protein, 351 aa, Ehrlichia chaffeensis
MIIKFGVENLIDSAVEIVCKYFDIYQRNDAVKHVLHKCIKSLRTVEKKLKIYRGKEAKGHVISDSQFAEMEDLIKKVLMKVFEIDISYQKQHLSAEKMEEYKVAVSLLLDQIVRCKSYALKESDILPKVVGNATLKRSAYKCKHVVDFINKNRFLPMNMGRFDKLCFDLDLDPQILKQVIDLCSFALIFEILDLKLVQFLVEMRFFPHQNTNVISITKDNYIELMQHIMLYKCSQSIGKEYTNEQARYLPCFSPGYTRGNVKGNSFICLGIALFIAQALFNGFGLLFMLLSEFKTQNDWWFIGICVVNMLLAVTALTLICIGKKQLSQNHDTLLTDIDVSGINIVEESVDL

SEQ ID NO: 6 - DNA, 1236 bp, Ehrlichia chaffeensis
atgggggatgttttgaatagaaaatttttagcatggtttttagtctcaatgttttatgcgtatcagtatatattgagagtaattcctaatgttattgtctctgtgtctatggagaagttcaaaattagtgctatggcatttggtcaattttctggtttatattatattggatatacgttagcacatataccgctaggtattcttttagataaatatgggcctaagatagtattaccaatttgtgcagctctaacgtttattggattagtgccattgctaatatcagatgtgtggttatttgctcaaattgggagaataattacaggtgtaggttcagctggttctgctcttggcctttttaaagttgctagtatgtactatggcaacagatttgctagaatgtctggtatttctgttataataggactgctaggtgcaatgtatggaggactgccaattttatctttgttaaataaatttggttgggaaagtttattcttagtatttattattataggagctgttatagcgctgttgctatatttgtttatgttgccttatgataaagactccaatgttgaagataataaaggtctctgtgataaaattaagttgattgtatttaataagtacattgttatgatcagcttacttgcaggctttatgattggacctttggaaggttttgctgatggatgggttacttcatttttaaaggcagttagtaatatggataaagaagtagctgctttattgccttctacaatatttattggtatgtgctttggattgtttgtcttaccatatatgttggagaagaaatcatttaatagttggaatatacttatcacatctgctttggggatgttgtttcctttcctgatgttatatatcagtagttcggttatattggtcacaatatcattttttatgatagggtttttttcatcatatcagattatagcaacttgtaaggtactaagttatgttagtaataatgtagttgcattagctactgctgtaaataacatgatagctatggcttttggttatttctttcatactgctatatcttgtgtaatagatttgttatgggatggaaaaattgtagattcagagccagtatatactaaggcattaatgctaaaatctatgttatttattcctggtggattgcttataggagcaatagggtttatttacctgaaatatttggataagaaagagggtaagtaa

SEQ ID NO: 7 - protein, 279 aa, Ehrlichia chaffeensis
MKISFSEIIHNALKEDLGDKGDITTNSILINEKVNFAINTRENLVVCGIPILEEVFNMNKEHVKYEIHKKDGDITGKNSTLVSGEALAIYLLPIERVILNFIQHASGIASITRQFVDEVSGTKVKIRSTRKTTPGLRMLDKYSVCIGGGESYRDNLCDGVLIKDNHIASCGSITLAIQRLRKNLKNEYIAIECDNISQVEESLSNNVDMILLDNMSISEIKKAVDIVNGKSVLEVSGCVNIRNVRNIALTGVDYISIGCITNSFQNKDIGLDIEYNNNK

SEQ ID NO: 8 - DNA, 1843 bp, Artificial Sequence
  Synthetic transposon
taacaggttggctgataagtccccggtctaagcttgcatgcctgcaggtcgactctagattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcataatttaatccctatttgtagagctcatccatgccatgtgtaatcccagcagcagttacaaactcaagaaggaccatgtggtcacgcttttcgttgggatctttcgaaagggcagattgtgtcgacaggtaatggttgtctggtaaaaggacagggccatcgccaattggagtattttgttgataatggtctgctagttgaacggaaccatcttcaatgttgtggcgaattttgaagttagctttgattccattcttttgtttgtctgccgtgatgtatacattgtgtgagttatagttgtactcgagtttgtgtccgagaatgtttccatcttctttaaaatcaataccttttaactcgatacgattaacaagggtatcaccttcaaacttgacttcagcacgcgtcttgtagttcccgtcatctttgaaagatatagtgcgttcctgtacataaccttcgggcatggcactcttgaaaaagtcatgccgtttcatatgatccggataacgggaaaagcattgaacaccataagagaaagtagtgacaagtgttggccatggaacaggtagttttccagtagtgcaaataaatttaagggtaagttttccgtatgttgcatcaccttcaccctctccactgacagaaaatttgtgcccattaacatcaccatctaattcaacaagaattgggacaactccagtgaaaagttcttctcctttactcattataatatcccttatgttactcagataacttaggataaatcatacataatgttaatgcaacagttatttaatgtatggttgtaataataaaactgtaaatggtatgctagattaaaaataaaatcatcaataaatatccgggaaacttccggagattttttgaggcagcgcgctgggcacttgttagtgcgcgcgttttatgctagcatgcggcgatcgttctaggaggagccgaattcagaccggggacttatcagccaacctgtta

SEQ ID NO: 9 - DNA, 1837 bp, Artificial Sequence
  Synthetic transposon
taacaggttggctgataagtccccggtctgaattcggctcctcctagaacgatcgccgcatgctagcataaaacgcgcgcactaacaagtgcccagcgcgctgcctcaaaaaatctccggaagtttcccggatatttattgatgattttatttttaatctagcataccatttacagttttattattacaaccatacattaaataactgttgcattaacattatgtatgatttatcctaagttatctgagtaacataagggatattataatggtcagcaagggagaggaagataatatggcgatcatcaaagagtttatgagatttaaggtgcacatggaaggaagcgttaatggtcatgagtttgaaatcgaaggcgaaggcgaaggaagaccgtatgaaggcacacagacggctaaacttaaggtcacaaaaggcggaccgcttccattcgcgtgggatattctttcaccgcaatttatgtatggttctaaagcctatgtgaaacatcctgcggatattcctgactaccttaaactgtctttcccggaaggatttaaatgggaacgcgtcatgaacttcgaagatggcggcgttgttacggtgacgcaggattcatcactgcaagatggagaatttatttataaagttaaactgcgcggcacaaactttccgtcagacggacctgtcatgcagaagaaaacgatgggctgggaagccagcagcgagagaatgtacccggaggacggagcacttaaaggcgaaatcaagcaacgcctgaagctgaaagatggaggccattatgatgccgaggtcaagacgacatacaaagctaagaaaccggtacaattacctggagcatacaacgtcaatatcaagctggatattacgtcacataatgaagactatacgattgtagagcaatatgaaagagcagagggaagacactctacaggtggaatggacgaattatacaaatagggattaaattatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatctagagtcgacctgcaggcatgcaagcttagaccggggacttatcagccaacctgtta

SEQ ID NO: 10 - DNA, 2398 bp, Ehrlichia chaffeensis
  mutation (213)..(2055): transposon mutation
atgctagaaagttctatgctgtgtattacacgtaaaattgtacctgtatcctcacctatcaccttatcagaagtaaaatccttcctacgcattaacaataatcaagatgatacattaattaataacttaattactatggcatctgaatatgcacaatggtatatagaaaaatcattaatgaaacaaacatgggaaatttcctgtagtagatataacaggttggctgataagtccccggtctaagcttgcatgcctgcaggtcgactctagattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcataatttaatccctatttgtagagctcatccatgccatgtgtaatcccagcagcagttacaaactcaagaaggaccatgtggtcacgcttttcgttgggatctttcgaaagggcagattgtgtcgacaggtaatggttgtctggtaaaaggacagggccatcgccaattggagtattttgttgataatggtctgctagttgaacggaaccatcttcaatgttgtggcgaattttgaagttagctttgattccattcttttgtttgtctgccgtgatgtatacattgtgtgagttatagttgtactcgagtttgtgtccgagaatgtttccatcttctttaaaatcaataccttttaactcgatacgattaacaagggtatcaccttcaaacttgacttcagcacgcgtcttgtagttcccgtcatctttgaaagatatagtgcgttcctgtacataaccttcgggcatggcactcttgaaaaagtcatgccgtttcatatgatccggataacgggaaaagcattgaacaccataagagaaagtagtgacaagtgttggccatggaacaggtagttttccagtagtgcaaataaatttaagggtaagttttccgtatgttgcatcaccttcaccctctccactgacagaaaatttgtgcccattaacatcaccatctaattcaacaagaattgggacaactccagtgaaaagttcttctcctttactcattataatatcccttatgttactcagataacttaggataaatcatacataatgttaatgcaacagttatttaatgtatggttgtaataataaaactgtaaatggtatgctagattaaaaataaaatcatcaataaatatccgggaaacttccggagattttttgaggcagcgcgctgggcacttgttagtgcgcgcgttttatgctagcatgcggcgatcgttctaggaggagccgaattcagaccggggacttatcagccaacctgttatatacctggaaaaatacaattgttatttaatccaataataaaagtgaatcatgtaaaaataatacacacaaatggaagtgaagaattgatagatcaaaaatactatcacgttaacacagtactatcatacatttcatttaataagcatatccatggagatagaatagaaattctatatgaagcaggatatacagacaatgcgttaataccagcacaaattagatatggcatattacatcacgtcgctatatcatataaaaatagagaatcagaaaatattaataatttaacttttataaaaaatatatattcccccttccgtgaactgaagttagttttatga

SEQ ID NO: 11 - DNA, 2893 bp, Ehrlichia chaffeensis
  mutation (683)..(2519): transposon mutation
atgataataaagtttggggttgaaaatctgatcgatagtgctgtggaaatagtttgtaaatattttgatatatatcagcgaaatgatgcagtaaaacatgtattacataaatgtattaaaagtttaagaactgtagaaaagaaattaaagatatatagagggaaagaagctaaaggacatgtaattagtgatagccaatttgctgaaatggaggatctaataaaaaaagttctcatgaaggtgtttgagattgatatttcttatcaaaaacaacacttgtctgcagaaaaaatggaggagtataaagtagctgttagtcttttattggatcaaatagtaaggtgtaagtcttatgctcttaaagaaagtgatattcttcctaaggttgtagggaatgcaaccttaaaacgtagtgcatataagtgtaagcatgtagtggattttattaataagaatagatttcttcctatgaatatggggagatttgataagctttgttttgatctagatttagatcctcagattttgaaacaagttatagatttatgcagttttgctcttatatttgaaattttggatcttaagttagtacaatttcttgttgaaatgagattctttccacatcaaaacactaatgtaattagtataactaaagataattacatagaattaatgcagcatataacaggttggctgataagtccccggtctgaattcggctcctcctagaacgatcgccgcatgctagcataaaacgcgcgcactaacaagtgcccagcgcgctgcctcaaaaaatctccggaagtttcccggatatttattgatgattttatttttaatctagcataccatttacagttttattattacaaccatacattaaataactgttgcattaacattatgtatgatttatcctaagttatctgagtaacataagggatattataatggtcagcaagggagaggaagataatatggcgatcatcaaagagtttatgagatttaaggtgcacatggaaggaagcgttaatggtcatgagtttgaaatcgaaggcgaaggcgaaggaagaccgtatgaaggcacacagacggctaaacttaaggtcacaaaaggcggaccgcttccattcgcgtgggatattctttcaccgcaatttatgtatggttctaaagcctatgtgaaacatcctgcggatattcctgactaccttaaactgtctttcccggaaggatttaaatgggaacgcgtcatgaacttcgaagatggcggcgttgttacggtgacgcaggattcatcactgcaagatggagaatttatttataaagttaaactgcgcggcacaaactttccgtcagacggacctgtcatgcagaagaaaacgatgggctgggaagccagcagcgagagaatgtacccggaggacggagcacttaaaggcgaaatcaagcaacgcctgaagctgaaagatggaggccattatgatgccgaggtcaagacgacatacaaagctaagaaaccggtacaattacctggagcatacaacgtcaatatcaagctggatattacgtcacataatgaagactatacgattgtagagcaatatgaaagagcagagggaagacactctacaggtggaatggacgaattatacaaatagggattaaattatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatctagagtcgacctgcaggcatgcaagcttagaccggggacttatcagccaacctgttattatgctttataaatgttctcagtctattggcaaagagtatactaatgagcaagcaaggtacttaccttgtttttcacctggttatactcggggtaatgttaagggcaattcattcatatgtttaggaatagctttgtttatagcacaagctctatttaatggatttgggttattatttatgttgctgtctgaatttaagacacaaaatgattggtggtttattggcatatgtgttgttaatatgctcttagccgttactgctcttacgttgatttgtattggaaagaaacaactgagtcaaaatcatgataccttattaacggatatagatgtcagtggtattaatattgttgaagaaagtgtagatttatag

SEQ ID NO: 12 - DNA, 3101 bp, Ehrlichia chaffeensis
  mutation (1254)..(3090): transposon mutation
atgggggatgttttgaatagaaaatttttagcatggtttttagtctcaatgttttatgcgtatcagtatatattgagagtaattcctaatgttattgtctctgtgtctatggagaagttcaaaattagtgctatggcatttggtcaattttctggtttatattatattggatatacgttagcacatataccgctaggtattcttttagataaatatgggcctaagatagtattaccaatttgtgcagctctaacgtttattggattagtgccattgctaatatcagatgtgtggttatttgctcaaattgggagaataattacaggtgtaggttcagctggttctgctcttggcctttttaaagttgctagtatgtactatggcaacagatttgctagaatgtctggtatttctgttataataggactgctaggtgcaatgtatggaggactgccaattttatctttgttaaataaatttggttgggaaagtttattcttagtatttattattataggagctgttatagcgctgttgctatatttgtttatgttgccttatgataaagactccaatgttgaagataataaaggtctctgtgataaaattaagttgattgtatttaataagtacattgttatgatcagcttacttgcaggctttatgattggacctttggaaggttttgctgatggatgggttacttcatttttaaaggcagttagtaatatggataaagaagtagctgctttattgccttctacaatatttattggtatgtgctttggattgtttgtcttaccatatatgttggagaagaaatcatttaatagttggaatatacttatcacatctgctttggggatgttgtttcctttcctgatgttatatatcagtagttcggttatattggtcacaatatcattttttatgatagggtttttttcatcatatcagattatagcaacttgtaaggtactaagttatgttagtaataatgtagttgcattagctactgctgtaaataacatgatagctatggcttttggttatttctttcatactgctatatcttgtgtaatagatttgttatgggatggaaaaattgtagattcagagccagtatatactaaggcattaatgctaaaatctatgttatttattcctggtggattgcttataggagcaatagggtttatttacctgaaatatttggataagaaagagggtaagtaacacatggtactacagtttaacaggttggctgataagtccccggtctgaattcggctcctcctagaacgatcgccgcatgctagcataaaacgcgcgcactaacaagtgcccagcgcgctgcctcaaaaaatctccggaagtttcccggatatttattgatgattttatttttaatctagcataccatttacagttttattattacaaccatacattaaataactgttgcattaacattatgtatgatttatcctaagttatctgagtaacataagggatattataatggtcagcaagggagaggaagataatatggcgatcatcaaagagtttatgagatttaaggtgcacatggaaggaagcgttaatggtcatgagtttgaaatcgaaggcgaaggcgaaggaagaccgtatgaaggcacacagacggctaaacttaaggtcacaaaaggcggaccgcttccattcgcgtgggatattctttcaccgcaatttatgtatggttctaaagcctatgtgaaacatcctgcggatattcctgactaccttaaactgtctttcccggaaggatttaaatgggaacgcgtcatgaacttcgaagatggcggcgttgttacggtgacgcaggattcatcactgcaagatggagaatttatttataaagttaaactgcgcggcacaaactttccgtcagacggacctgtcatgcagaagaaaacgatgggctgggaagccagcagcgagagaatgtacccggaggacggagcacttaaaggcgaaatcaagcaacgcctgaagctgaaagatggaggccattatgatgccgaggtcaagacgacatacaaagctaagaaaccggtacaattacctggagcatacaacgtcaatatcaagctggatattacgtcacataatgaagactatacgattgtagagcaatatgaaagagcagagggaagacactctacaggtggaatggacgaattatacaaatagggattaaattatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatctagagtcgacctgcaggcatgcaagcttagaccggggacttatcagccaacctgttaatatataatca

SEQ ID NO: 13 - DNA, 24 bp, Artificial Sequence
  Synthetic primer
ttgctgatagtgtggcagctgaag

SEQ ID NO: 14 - DNA, 23 bp, Artificial Sequence
  Synthetic primer
tctccatcttggataacagcagg

SEQ ID NO: 15 - DNA, 24 bp, Artificial Sequence
  Synthetic primer
tgtgtcctgttgttatgggttctc

SEQ ID NO: 16 - DNA, 28 bp, Artificial Sequence
  Synthetic primer
tccctaagtaatatggaaccatctgcac

SEQ ID NO: 17 - DNA, 23 bp, Artificial Sequence
  Synthetic primer
tctgctagaagtgctactctagg

SEQ ID NO: 18 - DNA, 21 bp, Artificial Sequence
  Synthetic primer
tcccacagtgtagctctctgc

SEQ ID NO: 19 - DNA, 24 bp, Artificial Sequence
  Synthetic primer
atgactgctgccattacagttggg

SEQ ID NO: 20 - DNA, 22 bp, Artificial Sequence
  Synthetic primer
cctcatcacttgttcctccttc

SEQ ID NO: 21 - DNA, 27 bp, Artificial Sequence
  Synthetic primer
tgctatagggatacctgtagcttttgc

SEQ ID NO: 22 - DNA, 25 bp, Artificial Sequence
  Synthetic primer
gcaagaccatcgtacgtactaggtg

SEQ ID NO: 23 - DNA, 23 bp, Artificial Sequence
  Synthetic primer
ctaaggttgtagggaatgcaacc

SEQ ID NO: 24 - DNA, 24 bp, Artificial Sequence
  Synthetic primer
acaaggtaagtaccttgcttgctc

SEQ ID NO: 25 - DNA, 23 bp, Artificial Sequence
  Synthetic primer
atgtgctctgtatcaattgcttg

SEQ ID NO: 26 - DNA, 26 bp, Artificial Sequence
  Synthetic primer
aacaaagaagtaaaaagacatacatg

SEQ ID NO: 27 - DNA, 22 bp, Artificial Sequence
  Synthetic primer
actccttggcaatggtgtgtag

SEQ ID NO: 28 - DNA, 24 bp, Artificial Sequence
  Synthetic primer
aatcgctctagacaacactgaagg

SEQ ID NO: 29 - DNA, 24 bp, Artificial Sequence
  Synthetic primer
tatgtaacttctttgcctcttatg

SEQ ID NO: 30 - DNA, 23 bp, Artificial Sequence
  Synthetic primer
atgaaatctttagtgactcgacc

SEQ ID NO: 31 - DNA, 29 bp, Artificial Sequence
  Synthetic primer
actagatgaatttgactatacaattgatg

SEQ ID NO: 32 - DNA, 25 bp, Artificial Sequence
  Synthetic primer
tttaagctttgtaagctgttagaat

SEQ ID NO: 33 - DNA, 25 bp, Artificial Sequence
  Synthetic primer
tgtacctgtatcctcacctatcacc

SEQ ID NO: 34 - DNA, 28 bp, Artificial Sequence
  Synthetic primer
ctatcaattcttcacttccatttgtgtg

SEQ ID NO: 35 - DNA, 23 bp, Artificial Sequence
  Synthetic primer
atctactgctaccaacccaatac

SEQ ID NO: 36 - DNA, 25 bp, Artificial Sequence
  Synthetic primer
tagtgcatatgcaatttcattgtgc

We claim:

1. A method of inducing an immune response against infection by wild type *Ehrlichia chaffeensis* in a mammalian subject, said method comprising administering an effective amount of an immunogenic composition to said subject, said composition comprising live, attenuated *E. chaffeensis* mutant dispersed in a pharmaceutically acceptable carrier, said live, attenuated *E. chaffeensis* mutant comprising a mutation in the Ech_0660 target gene of SEQ ID NO: 2 that results in attenuated growth of the mutant *E. chaffeensis* in the subject, wherein said mutation is an insertion mutation and wherein the immune response reduces symptoms and/or duration of the *E. chaffeensis* infection upon exposure of the subject to wild type *E. chaffeensis* infection as compared to a corresponding unvaccinated control mammalian subject.

2. The method of claim 1, wherein said administering comprises injecting said immunogenic composition intramuscularly, subcutaneously, intradermally, or intravenously using a needle and syringe, or a needleless injection device.

3. The method of claim 1, wherein said immunogenic composition is administered as a unit dosage form.

4. The method of claim 1, wherein said subject is a non-human mammal.

5. The method of claim 1, wherein said immune response in said subject is selected from the group consisting of *E. chaffeensis*-specific humoral immunity, production of *E. chaffeensis*-specific serum IgG, *E. chaffeensis*-specific cellular immunity, production of *E. chaffeensis*-specific IFN gamma, and/or production of IL-17, after exposure to wild type *E. chaffeensis* infection.

6. The method of claim 1, wherein said attenuated *E. chaffeensis* is *E. chaffeensis* strain Arkansas.

7. The method of claim 5, wherein said non-human mammal is a dog or a deer.

8. The method of claim 1, wherein said carrier is selected from the group consisting of normal saline, phosphate buffered saline, sterile water, aqueous dextrose solution, aqueous glycerol solution, ethanol, normal allantoic fluid, oil-in-water or water-in-oil emulsion, dimethyl sulfoxide, and mixtures thereof.

9. The method of claim 1, wherein said infection is tick-transmitted *E. chaffeensis* infection.

10. The method of claim 1, wherein the mutation is an insertion in a protein coding region of the Ech_0660 target gene.

11. The method of claim 1, wherein said insertion comprises insertion of at least one heterologous sequence and optionally insertion of at least one reporter gene stably incorporated therein.

12. The method of claim 1, wherein the mutation comprises insertion of SEQ ID NO: 8 or SEQ ID NO: 9 into the Ech_0660 target gene.

13. The method of claim 1, wherein the mutation in the Ech_0660 target gene results in the mutated gene of SEQ ID NO: 10.

14. The method of claim 1, wherein said mutation results in inhibition and/or inactivation of transcription and/or translation of the gene product of SEQ ID NO: 3.

* * * * *